(12) United States Patent
Reuzeau et al.

(10) Patent No.: US 8,575,421 B2
(45) Date of Patent: Nov. 5, 2013

(54) PLANTS HAVING ENHANCED YIELD-RELATED TRAITS AND A METHOD FOR MAKING THE SAME

(75) Inventors: Christophe Reuzeau, Tocan Saint Apre (FR); Valerie Frankard, Waterloo (BE); Yves Hatzfeld, Lille (FR); Ana Isabel Sanz Molinero, Gentbrugge (BE)

(73) Assignee: BASF Plant Science GmbH, Ludwigshafen (DE)

( * ) Notice: Subject to any disclaimer, the term of this patent is extended or adjusted under 35 U.S.C. 154(b) by 267 days.

(21) Appl. No.: 12/808,208

(22) PCT Filed: Dec. 22, 2008

(86) PCT No.: PCT/EP2008/068129
§ 371 (c)(1),
(2), (4) Date: Jun. 15, 2010

(87) PCT Pub. No.: WO2009/080802
PCT Pub. Date: Jul. 2, 2009

(65) Prior Publication Data
US 2010/0269219 A1 Oct. 21, 2010

Related U.S. Application Data

(60) Provisional application No. 61/027,155, filed on Feb. 8, 2008, provisional application No. 61/027,105, filed on Feb. 8, 2008, provisional application No. 61/027,513, filed on Feb. 11, 2008, provisional application No. 61/027,499, filed on Feb. 11, 2008.

(30) Foreign Application Priority Data

Dec. 20, 2007 (EP) .................. 07123820
Dec. 21, 2007 (EP) .................. 07124011
Dec. 21, 2007 (EP) .................. 07124036
Dec. 24, 2007 (EP) .................. 07025090

(51) Int. Cl.
*A01H 5/00* (2006.01)
*C12N 15/11* (2006.01)
*C12N 15/63* (2006.01)
*C12N 15/82* (2006.01)

(52) U.S. Cl.
USPC ....... 800/278; 800/298; 800/320.2; 435/91.1; 435/468; 435/419; 435/320.1; 530/350; 536/23.1

(58) Field of Classification Search
None
See application file for complete search history.

(56) References Cited

U.S. PATENT DOCUMENTS

| 2003/0121070 A1* | 6/2003 | Adam et al. .................. 800/278 |
| 2008/0127365 A1 | 5/2008 | Sanz Molinero et al. |
| 2009/0019606 A1 | 1/2009 | Frankard |
| 2009/0241218 A1 | 9/2009 | Frankard et al. |
| 2010/0011464 A1 | 1/2010 | Frankard |
| 2010/0024067 A1 | 1/2010 | Sanz Molinero et al. |
| 2010/0031389 A1 | 2/2010 | Reuzeau |
| 2010/0077502 A1 | 3/2010 | Broekaert et al. |
| 2010/0132071 A1 | 5/2010 | Hatzfeld et al. |
| 2010/0192251 A1 | 7/2010 | Hatzfeld et al. |
| 2010/0199379 A1 | 8/2010 | Sanz Molinero et al. |
| 2010/0199380 A1 | 8/2010 | Frankard et al. |
| 2010/0199382 A1 | 8/2010 | Frankard et al. |
| 2010/0205689 A1 | 8/2010 | Hatzfeld |
| 2010/0218271 A1 | 8/2010 | Sanz Molinero et al. |
| 2010/0251423 A1 | 9/2010 | Sanz Molinero |
| 2010/0269219 A1 | 10/2010 | Reuzeau et al. |
| 2010/0313299 A1 | 12/2010 | Sanz Molinero et al. |
| 2010/0325753 A1 | 12/2010 | Hatzfeld et al. |
| 2011/0004963 A1 | 1/2011 | Frankard et al. |
| 2011/0016586 A1 | 1/2011 | Sanz Molinero et al. |
| 2011/0041210 A1 | 2/2011 | Hatzfeld et al. |
| 2011/0061126 A1 | 3/2011 | Frankard et al. |
| 2011/0061133 A1 | 3/2011 | Reuzeau et al. |
| 2011/0061134 A1 | 3/2011 | Deng et al. |
| 2011/0098183 A1 | 4/2011 | Blasing et al. |
| 2011/0099669 A1 | 4/2011 | Sanz Molinero et al. |
| 2011/0107464 A1 | 5/2011 | Hatzfeld et al. |
| 2011/0107465 A1 | 5/2011 | Reuzeau et al. |
| 2011/0131684 A1 | 6/2011 | Sanz Molinero et al. |
| 2011/0145949 A1 | 6/2011 | Hatzfeld et al. |
| 2011/0162109 A1 | 6/2011 | Himanen et al. |
| 2011/0162110 A1 | 6/2011 | De Jaeger et al. |

(Continued)

FOREIGN PATENT DOCUMENTS

| WO | WO-2006/076423 A2 | 7/2006 |
| WO | WO-2007/051866 A2 | 5/2007 |
| WO | WO-2007/113237 A2 | 10/2007 |
| WO | WO-2008/062049 A1 | 5/2008 |

OTHER PUBLICATIONS

Palatnik et al Nature, vol. 425, 2003, p. 257-263.*
Song et al (The Plant Cell, vol. 18, 2006, p. 2258-2274).*

(Continued)

*Primary Examiner* — Brent T Page
*Assistant Examiner* — Lee A Visone
(74) *Attorney, Agent, or Firm* — Novak Druce Connolly Bove + Quigg LLP

(57) ABSTRACT

The present invention relates generally to the field of molecular biology and concerns a method for enhancing various yield-related traits in plants by modulating expression in a plant of a nucleic acid encoding a TCP1 transcription factor. The present invention also concerns plants having modulated expression of a nucleic acid encoding a TCP1 polypeptide, which plants have enhanced yield-related traits relative to corresponding wild type plants or other control plants. The invention also provides constructs useful in the methods of the invention.

24 Claims, 91 Drawing Sheets

(56) References Cited

U.S. PATENT DOCUMENTS

| | | |
|---|---|---|
| 2011/0179526 A1 | 7/2011 | Sanz Molinero et al. |
| 2011/0209241 A1 | 8/2011 | Hatzfeld et al. |
| 2011/0214207 A1 | 9/2011 | Frankard et al. |
| 2011/0247098 A1 | 10/2011 | Hatzfeld et al. |
| 2011/0252508 A1 | 10/2011 | Sanz Molinero et al. |
| 2011/0271404 A1 | 11/2011 | Hatzfeld et al. |
| 2011/0321197 A1 | 12/2011 | Schon et al. |
| 2012/0030836 A1 | 2/2012 | Hatzfeld et al. |

OTHER PUBLICATIONS

Cubas et al (The Plant Journal (1999) 18(2) 215-22).*

Friedberg (Brief. Bioinformatics (2006) 7: 225-242).*

Palatnik, J.F., et al., "Control of leaf morphogenesis by microRNAs," Nature, 2003, vol. 425, No. 6955. pp. 257-263.

Li, C., et al., "*Arabidopsis* TCP20 links regulation of growth and cell division control pathways," PNAS, 2005, vol. 102, No. 36, pp. 12978-12983.

Cubas, P., et al., "The TCP domain: a motif found in proteins regulating plant growth and development," The Plant Journal, 1999, vol. 18, No. 2, pp. 215-222.

Leroux, M.R., et al., "Molecular analysis of *Caenorhabditis elegans tcp-1*, a gene encoding a chaperonin protein," Gene, 1995, vol. 156, No. 2, pp. 241-246.

\* cited by examiner

MDFMKVFDQTVREIKREVNLKVLKVPEMEQKVLDATDNEPWGPHGTALAEIAQATKKFSECQMVMSVLWT
              1
RLSETGKDWRYVYKALAVIDYLISNGSERAVDEIIEHTYQISSLTSFEYVEPNGKDVGINVRKKAENIVA
                                                  2
LLNNKEKISEIRDKAVANRNKYVGLSSTGITYKSGSSASFGGSFQSGSSNFDSYKDRDSREDKNDYESFQ
            3
KSRRGVKTEEQSYTSKKSFSRYGSTDHDNLSSGKKSPDSAKHRSYVSAAPSNNDDDFDDFDPRGTSSNKP

STGSANQVDLFGGDLIGDFLDSGPTETSSTNNNENFQEADLFADAAFVSASAQGAEFGSQTQKQVDLFSA

SEPSVTVSSAPPTVDLFASSESVVSPEAKISIPESMATPNIVDPFAAVPMDNFDGSDPFGAFTSHSASVS

TGPQAPSVHGSATNTTSPLSFADSKPQHLQKKDPFQVKSGIWADSLSRGLIDLNITAPKKASLADVGVVG
                                        4                         5
DLSNEDGNKASAASYYSGWSMGAGSGLGKTGLYSTQQQQQQQQQQQAPDISDDFFSSLSNQRYQSGGFKQ

FIGURE 3

```
CLUSTAL W (1.83) multiple sequence alignment

CAO45312.1           -------MKKAIGQTVRDLKREVNKKVLKVPG-IEQKVLDATSNEPWGPHGTHLADIAQA
CAN66991.1           --------------------------MPGSDERMVLDATSNEPWGPHGTHLADIAQA
ABN08674.1           -------MKKVFGQTVRDLKREVNKKVLKVPG-IEQKVLDATSNEPWGPHGTLLADIAQA
NP_850387.1          -------MKKVFGQTVRDLKREVNKKVLKVPG-VEQKVLDATSNEPWGPHGSLLADLAQA
BAD44158.1           -------MKKVFGQTVRDLKREVNKKVLKVPG-VEQKVLDATSNEPWGPHGSLLADLAQA
BAF01674.1           -------MKKVFGQTVRDLKREVNKKVLKVPG-VEQKVLDATSNEPWGPHGSLLADLAQA
AAN72258.1           -------MKKVFGQTVRDLKREVNKKVLKVPG-VEQKVLDATSNEPWGPHGSLLADLAQA
AAC64305.1           -------MKKVFGQTVRDLKREVNKKVLKVPG-VEQKVLDATSNEPWGPHGSLLADLAQA
CAB91599.1           -------MKKAFGQTVRDLKRGVNKKVLKVPG-IEQKVLDATSNESWGPHGSLLADIAHA
AAL24360.1           -------MKKAFGQTVRDLKRGVNKKVLKVPG-IEQKVLDATSNESWGPHGSLLADIAHA
BAD19387.1           -------MKKVFDQTVRDLKREVNKKVLKVPG-IEQKILDATSNEPWGPHGSLLAEIAQA
EAZ25008.1           -------MKKVFDQTVRDLKREVNKKVLKVPG-IEQKILDATSNEPWGPHGSLLAEIAQA
EAZ13473.1           -----MDFRKVLDQTVREIRREVNLKVLKVPE-IEQKVLDATSDEPWGPHGSDLADIARA
EAY75756.1           -----MDFRKVLDQTVREIRREVNLKVLKVPE-IEQKVLDATSDEPWGPHGSDLADIARA
BAD87030.1           -----MDFRKVLDQTVREIRREVNLKVLKVPE-IEQKVLDATSDEPWGPHGSDLADIARA
SEQID2               -----MDFMKVFDQTVREIKREVNLKVLKVPE-MEQKVLDATDNEPWGPHGTALAEIAQA
CAB87689.1           -----MDFMKVFDQTVREIKREVNLKVLKVPE-MEQKVLDATDNEPWGPHGTALAEIAQA
CAO43767.1           -----MDFMKVFDQTVREIKREVNLKVLKVPE-IEQKVLDATDNEPWGPHGSALAEIAQA
CAD41810.2           -----MDFVKVFDQAVREIKREVNLKVLKVPE-LEQKVLDATSDEPWGPHGTTLSELSHA
EAY95411.1           -----MDFVKVFDQAVREIKREVNLKVLKVPE-LEQKVLDATSDEPWGPHGTTLSELSHA
AAB68030.1           -----MDFMKVFDQTVREIKREVNLKVLKVPE-LEQKVLDATSDEPWGPHGSALSDVAQA
XP_001701452.1       ---------------------------MWHTVAFTKLKVLEATNEEPWGPHGSAMGEIARA
XP_001419857.1       MFKAALTTIKSAIPDEVAQAAKKRVNQWKGIGDDEALVRDATNSEPWGPHGEQLRAIARL
                          :   :**..*.***** :  :::
```

FIGURE 4

```
CAO45312.1        TRNYHEYQMIMSVIWKRINDTGKNWRHVYKALTVLEYLVGHGSERVIDEIREHIYQISTL
CAN66991.1        TRNYHEYQMIMSVIWKRINDTGKNWRHVYK------------------------------TL
ABN08674.1        TRNPHEYQMIMSVVWKRINDTGKNWRHVYKALTVLEYLVAHGSERVIDEIKEHSYQISTL
NP_850387.1       SRNYHEYQLIMVVIWKRLSDTGKNWRHVYKALTVLEYMVGHGSERVIDEIRERAYQISTL
BAD44158.1        SRNYHEYQLIMVVIWKRLSDTGKNWRHVYKALTVLEYMVGHGSERVIDEIRERAYQISTL
BAF01674.1        SRNYHEYQLIMVVIWKRLSDTGKNWRHVYKALTVLEYMVGHGSERVIDEIRERAYQISTL
AAN72258.1        SRNYHEYQLIMVVIWKRLSDTGKNWRHVYKALTVLEYMVGHGSERVIDEIRERAYQISTL
AAC64305.1        SRNYHEYQLIMVVIWKRLSDTGKNWRHVYKALTVLEYMVGHGSERVIDEIRERAYQISTL
CAB91599.1        SRNYHEYQITMGVLWKRLSDSGKNWRHVYKALTVLEYMVGHGSERVIEEVKEHAYQITTL
AAL24360.1        SRNYHEYQITMGVLWKRLSDSGKNWRHVYKALTVLEYMVGHGSERVIEEVKEHAYQITTL
BAD19387.1        TQNYHEYQMVMNVVWKRINDTGKNWRHVYKGLIVLDYLVAHGTERVIDDIREHSYQISTL
EAZ25008.1        TQNYHEYQMVMNVVWKRINDTGKNWRHVYKGLIVLDYLVAHGTERVIDDIREHSYQISTL
EAZ13473.1        TKSYGDSEIIMNVLWQRLGNTLANWRHVYKALAVIEYLLANGTERAADGIVDNSSRIAKL
EAY75756.1        TKSYGDSEIIMNVLWQRLGNTLANWRHVYKALAVIEYLLANGTERAADGIVENSSRIAKL
BAD87030.1        TKSYGDSEIIMNVLWQRLGNTLANWRHVYKALAVIEYLLANGTERAADGIVDNSSRIAKL
SEQID2            TKKFSECQMVMSVLWTRLSETGKDWRYVYKALAVIDYLISNGSERAVDEIIEHTYQISSL
CAB87689.1        TKKFSECQMVMSVLWTRLSETGKDWRYVYKALAVIDYLISNGSERAVDEIIEHTYQISSL
CAO43767.1        TKKFTECQMVMNVLWTRLSDSGRDWRHVYKSLAVIEYLVANGSERAVDDIIEHTFQISSL
CAD41810.2        TKKFAECQMVMSVLWTRLSERGSKWRHVYKALTIIEYLIANGSERAVDDILDHYSKISVL
EAY95411.1        TKKFTGALYYEFYIGHYANTNG-QSEQQTLALTIIEYLIANGSERAVDDILDHYSKISVL
AAB68030.1        TKKYSECQMVMGVLWARLAERDSNWRHVYKALTIIEYLIANGSERAVDNILDHFSKISVL
XP_001701452.1    AEDPEKYNLIMNVISERLQMRDENWRLCYKALLLLEYLVKNGPWRVVDELNRSVSSLERL
XP_001419857.1    TRD-GKWDVVREVLEKRLKSAPEEWRRAYKALTVVEYLVANGDRAIAEDVRRRRMMDGAL
                  :..              :       ..                    *

CAO45312.1        SD-FQYIDSSGRDQGSNVRKKSQSLVALVNDKERIQEVRQKAAANRDKFRNTNSAGGMYR
CAN66991.1        SD-FQYIDSSGRDQGSNVRKKSQSLVALVNDKERIQEVRQKAAANRDKFRNTNSAGGMYR
ABN08674.1        SD-FQYIDSSGRDQGNNVRKKSQNLVVLVNDKERIEVEVRQKAAVNREKFRN-NTPGGMYR
NP_850387.1       SD-FQYIDSGGRDQGSNVRKKSQSLVALVNDKERIAEVRQKAAANRDKYRSSAPG-GMYK
BAD44158.1        SD-FQYIDSGGRDQGSNVRKKSQSLVALVNDKERIAEVRQKAAANRDKYRSSAPG-GMYK
BAF01674.1        SD-FQYIDSGGRDQGSNVRKKSQSLVALVNDKERIAEVRQKAAANRDKYRSSAPG-GMYK
AAN72258.1        SD-FQYIDSGGRDQGSNVRKKSQSLVALVNDKERIAEVRQKAAANRDKYRSSAPG-GMYK
AAC64305.1        SD-FQYIDSGGRDQGSNVRKKSQSLVALVNDKERIAEVRQKAAANRDKYRSSAPG-GMYK
CAB91599.1        SG-FQYIDSSGKDQGSNVRKKAQSLVALVNDKERITEVREKAAANRDKYHN-----SMHR
AAL24360.1        SG-FQYIDSSGKDQGSNVRKKAQSLVALVNDKERITEVREKAAANRDKYHN-----SMHR
BAD19387.1        AD-FQYIDSSGRDQGSNVRRKSQSLVSLVNDKERIQEVRQKALATRDKYRSAFATSGTHR
EAZ25008.1        AD-FQYIDSSGRDQGSNVRRKSQSLVSLVNDKERIQEVRQKALATRDKYRSAFATSGTHR
EAZ13473.1        TR-FEYLEPNGKDVGLNVRKKAEAVLAILDDREKLQEVREKAAVTRDKYFGLSSTGITHK
EAY75756.1        TR-FEYLEPNGKDVGLNVRKKAEAVLAILDDREKLQEVREKAAVTRDKYFGLSSTGITHK
BAD87030.1        TR-FEYLEPNGKDVGLNVRKKAEAVLAILDDREKLQEVREKAAVTRDKYFGLSSTGITHK
SEQID2            TS-FEYVEPNGKDVGINVRKKAENIVALLNNKEKISEIRDKAVANRNKYVGLSSTGITYK
CAB87689.1        TS-FEYVEPNGKDVGINVRKKAENIVALLNNKEKISEIRDKAVANRNKYVGLSSTGITYK
CAO43767.1        SG-FEYVEPNGKDVGINVRKKAETIVALLNNKEKIQEVRNKAAANRDKFFGLSSSGVTYK
CAD41810.2        SS-FEYVEPNGKDAGINVRKKVETILGLINDKEKIKSVREKAASNRDKYVGLSSTGITYK
EAY95411.1        SS-FEYVEPNGKDAGINVRKKVETILGLINDKEKIKSVREKAASNRDKYVGLSSTGITYK
AAB68030.1        SS-FEFVEPNGKDAGINVRKKVETLVGIINDKDRIKAVRDKAASNRDKYVGLSSTGSSYR
XP_001701452.1    RDEFEYRDPQGKDHGVNVRQRAGELASLVSNTDRVRQEREKAAKNANKYKGVSSSDMRGF
XP_001419857.1    R--FEYKDARGKDEGVNVRHRAEKIKALVEDPRSVEEAREKAERNRGKYAGMSSEEAR--
                  *:: :. *:* * ***:: :  ::.:     :   *:**   .  *: .
```

FIGURE 4 (continued)

```
CAO45312.1      PSSYSSSGGYG-DRYDDDRYEGRYGRDEDRN--GYGREREWGSRDDDRY-------GRNG
CAN66991.1      PSSYSSSGGYG-DRYDDDRYEGRYGRDEDRN--GYGREREWGSRDDDRY-------GRNG
ABN08674.1      PGSHSSIGSYG-DRYEEDRYAN---REEDRNGYGYGREREMGSRDDDRY-------NRDG
NP_850387.1     PS-----GGYG-DKYD------YGSRDEERS--SYGREREYGYRDDDRN-------SRDG
BAD44158.1      PS-----GGYG-DKYD------YGSRDEERS--SYGREREYGYRDDDRN-------SRDG
BAF01674.1      PS-----GGYG-DKYD------YGSRDEERS--SYGREREYGYRDDDRN-------SRDG
AAN72258.1      PS-----GGYG-DKYD------YGSRDEERS--SYGREREYGYRDDDRN-------SRDG
AAC64305.1      PS-----GGYG-DKYD------YGSRDEERS--SYGREREYGYRDDDRN-------SRDG
CAB91599.1      PS-----GGYG-DKYDYE--GRYGDRDEGRS--SYGKEREYGYRDDDRN-------SRDG
AAL24360.1      PS-----GGYG-DKYDYE--GRYGDRDEGRS--SYGKEREYGYRDDDRN-------SRDG
BAD19387.1      SP-----GGYDNDRYEGS----YGSRYDNRN--GYGGEREYGYRDDDRYGVAGTTPNREG
EAZ25008.1      SP-----GGYDNDRYEGS----YGSRYDNRN--GYGGEREYGYRDDDRYGVAGTTPNREG
EAZ13473.1      S---------------SAASFGSGSYSSG-------------------------------
EAY75756.1      S---------------SAASFGSGSYSSG-------------------------------
BAD87030.1      S---------------SAASFGSGSYSSG-------------------------------
SEQID2          SG--------------SSASFGG-SFQSG-------------------------------
CAB87689.1      SG--------------SSASFGG-SFQSG-------------------------------
CAO43767.1      S---------------SSAPYGSSSFQSA-------------------------------
CAD41810.2      S---------------SSASFGS-NYSSG-------------------------------
EAY95411.1      S---------------SSASFGS-NYSSG-------------------------------
AAB68030.1      S---------------SSATVGS-NYSSG-------------------------------
XP_001701452.1  GG--------------------GNLTWLPA-----------------------RPQ
XP_001419857.1  ------------------------------------------------------------

CAO45312.1      DSYEILMN-------------GMVEMAIRMMITGEEVEAMRTTSMALEVGVLIEIGTESN
CAN66991.1      DSYGPEGDRYGRDSDERYGRDGYKDDDYRGRSRSNEDYQYGSRSRSADRDRDRAFDEESN
ABN08674.1      DRYGRDYEER-------YGRDGYRDDD-RGRSRSVDYNYDDTRSRNSDRDRD--FDDDGQ
NP_850387.1     DRHSRDSEDR-------YGRDGNRDDDYRGRSRSVDNY--GSRGRSSERER----EDDGH
BAD44158.1      DRHSRDSEDR-------YGRDGNRDDDYRGRSRSVDNY--GSRGRSSERER----EDDGH
BAF01674.1      DRHSRDSEDR-------YGRDGNRDDDYRGRSRSVDNY--GSRGRSSERER----EDDGH
AAN72258.1      DHHSRDSEDR-------YGRDGNRDDDYRGRSRSVDNY--GSRGRSSERER----EDDGH
AAC64305.1      DRHSRDSEDR-------YGRDGNRDDDYRGRSRSVDNY--GSRGRSSERER----EDDGH
CAB91599.1      DRYSRDSEDR-------YGRDGNTDDEYRGRSRSVDNYN-GSRGRSSDRERP--IEDDGQ
AAL24360.1      DRYSRDSEDR-------YGRDGNTDDEYRGRSRSVDNYN-GSRGRSSDRERP--IEDDGQ
BAD19387.1      DRYSRDSNEQ---------RYSRDREDEYKGSHSNHEYAE-GSGRRSYGRDRD-SYGDDEA
EAZ25008.1      DRYSRDSNEQ---------RYSRDREDEYKGSHSNHEYAE-GSGRRSYGRDRD-SYGDDEA
EAZ13473.1      SHYG-------------STGGSREVGSFKDIHTGTEWK-----------------------
EAY75756.1      SHYG-------------STGGSREVGSFKDIHTGTEWK-----------------------
BAD87030.1      SHYG-------------STGGSREVGSFKDIHTGTEWK-----------------------
SEQID2          SSN----------------FDSYKDRDSR-EDKNDYESF---------------------
CAB87689.1      SSN----------------FDSYKDRDSR-EDKNDYESF---------------------
CAO43767.1      DQHGGMKNDS--------FRDSYKDRDRFDEEKVDEDTS---------------------
CAD41810.2      ERYG-------------SFSGTREGDSYGDSYRDKEPV----------------------
EAY95411.1      ERYG-------------SFSGTREGDSYGDSYRDKEPV----------------------
AAB68030.1      ERYG-------------SFGGTREGDSFSNSYKDKESA----------------------
XP_001701452.1  QAYPGTESVH-------MPAGSSSSHHSRTGSGSNANTF---------------------
XP_001419857.1  ------------------------THARRGSTSSA-------------------------
```

FIGURE 4 (continued)

```
CAO45312.1       HSSRGGARTDEHPQYGRQ--LERKFSEQNLD-APPSYEEAVADAHSPVHDERDG-ATPAA
CAN66991.1       HSSRGGARTDEHPQYGRQ--LERKFSEQNLD-APPSYEEAVADAHSPVHDERDG-ATPAA
ABN08674.1       HSSRGSNAKVEDQSLEAR--LQRKLSEQNSG-APPSYEEAVGEAQSPVP-ERDV-ETSAE
NP_850387.1      SSSRGSGARADDNSQDGRGGLQRKFSEQNIG-APPSYEEAVSDSRSPVYSERDGGETPQV
BAD44158.1       SSSRGSGARADDNSQDGRGGLQRKFSEQNIG-APPSYEEAVSDSRSPVYSERDGGETPQV
BAF01674.1       SSSRGSGARADDNSQDGRGGLQRKFSEQNIG-APPNYEEAVSDSRSPVYSERDGGETPQV
AAN72258.1       SSSRGSGARADDNSQDGRGGLQRKFSEQNIG-APPSYEEAVSDSRSPVYSERDGGETPQV
AAC64305.1       SSSR----------------YVKFQVA---------------------------------
CAB91599.1       SSSRDSGAPADDHSQDGRGGLERKFSEQNIGAAPPSYEEAVSESRSPVYSERDGGETPQV
AAL24360.1       SSSRDSGAPADDHSQDGRGGLERKFSEQNIGAAPPSYEEAVSESRSPVYSERDGGETPQV
BAD19387.1       YSSRGRQSNADGPTQDERP-MERKPSNQQIASPPPNYEDVTRDTQDNNHDGRNGGTVPVP
EAZ25008.1       YSSRGRQSNADGPTQDERP-MERKPSNQQIASPPPNYEDVTRDTQDNNHDGRNGGTVPVP
EAZ13473.1       --------------------------------KNKKETVSNYSSNREGSKEITNSATS
EAY75756.1       --------------------------------KNKKETVSNYSSNREGSKEITNSATS
BAD87030.1       --------------------------------KNKKETVSNYSSNREGSKEITNSATS
SEQID2           --------------------------------QKSRRGVKTEEQSYTSKKSFSRYGST
CAB87689.1       --------------------------------QKSRRGVKTEEQSYTSKKSFSRYGST
CAO43767.1       --------------------------------AKSRQGVTSENEGNTFKKGSARYSSK
CAD41810.2       --------------------------------KSSPSYTGSQKSGSRIKKDVNRRNED
EAY95411.1       --------------------------------KSSPSYTGSQKSGSRIKKDVNRRNED
AAB68030.1       --------------------------------KTSAGSNGSKKSGSKTRKDA--KHDR
XP_001701452.1   --------------------------------NAFNNPTAAGHSGGGFGGLRGTGPAAGS
XP_001419857.1   ---------------------------------------------GGSFSG--------GS

CAO45312.1       PAPKTSSPPVSTSPS--------------------QATTAVGPSTSPPANKEVDAFDEFD
CAN66991.1       PAPKTSSPPVSTSPS--------------------QATTAVGPSTSPPANKEVDAFDEFD
ABN08674.1       SAPRGSSPHASDNPSPASAPTGSSPVSNNPTEVTAAASTSVAASTAASTQETEPTDDFFD
NP_850387.1      TAPGAASPPPPQVAAPEAASPPTG----------TNTANTTATFVNESPSQKVETFDEFD
BAD44158.1       TAPGAASPPPPQVAAPEAASPPTG----------TNTANTTATFVNESPSQKVETFDEFD
BAF01674.1       TAPGAASPPPPQVAAPEAASPPTG----------TNTANTTATFVNESPSQKVETFDEFD
AAN72258.1       TAPGAASPPPPQVAAPEAASPPTG----------TNTANTTATFVNESPSQKVETFDEFD
AAC64305.1       ------------------------------------------------------------
CAB91599.1       APPGAAASPLAENIS--------------------VDNKAADFVNESSPQQVEAFDEFD
AAL24360.1       APPGAAASPLAENIS--------------------VDNKAADFVNESSPQQVEAFDEFD
BAD19387.1       VAAAKVSSPPRTSVPPGQVNG-------------VHDNTVEDVPAPPPTHPEVNGFDEFD
EAZ25008.1       VAAAKVSSPPRTSVPPGQVNG-------------VHDNTVEDVPAPPPTHPEVNGFDEFD
EAZ13473.1       YKSKKSERHGR-----------------------STTSEAPSSKKGENEDDDDFN
EAY75756.1       YKSKKSERHGR-----------------------SLMDDLVDSTTS---------
BAD87030.1       YKSKKSERHGRRNQNSLTLHSKLS-----------ANISTTSEAPSSKKGENEDDDDFN
SEQID2           DHDNLSSGKKSPDS---------------------AKHRSYVSAAPSNND-DDFDDFD
CAB87689.1       DHDNLSSGKKSPDS---------------------AKHRSYVSAAPSNND-DDFDDFD
CAO43767.1       DKDTLSTKANYSDKY--------------------GSIPSHSSSVPSINDEDDFDDFD
CAD41810.2       SPSSLKSNAK--------------------------------GNE-DDFDDFD
EAY95411.1       SPSSLKSNAK--------------------------------GNE-DDFDDFD
AAB68030.1       SSSKPPSTAK--------------------------------SNE-DDFDDFD
XP_001701452.1   GVGPEEGEDPFEATR---------------------KRIERLKAEGALPEPPPSAL
XP_001419857.1   ALG---G-----------------------------------------------------
```

FIGURE 4 (continued)

```
CAO45312.1      PRGPVSGMENPRDLSVCQY----------VQLESKQFACASVPATSISPEMDLLGSLSES
CAN66991.1      PRGPVS------------------------------AVPATSISPEMDLLGSLSES
ABN08674.1      PRGPTS------------------------------AAPTTSNFGEIDLLGSLSDS
NP_850387.1     PRSAFS-AGPPAYASTDG----------VTAPPTVTSMSAPTTSNSVEMDLLGSLADV
BAD44158.1      PRSAFS-AGPPAYASTDG----------VTAPPTVTSMSAPTTSNSVEMDLLGSLADV
BAF01674.1      PRSAFS-AGPPAYASTDG----------VTAPPTVTSMSAPTTSNSVEMDLLGSLADV
AAN72258.1      PRSAFS-AGPPAYASTDG----------VTAPPTVTSMSAPTTSNSVEMDLLGSLADV
AAC64305.1      ------------------------------------------------------------
CAB91599.1      PRGSVS-ACAPTAGASVP-----------APIPPTVVSTPAPPASINAEMDLLGSLSDV
AAL24360.1      PRGSVSAACAPTAGASVP-----------APIPPTVVSTPAPPASINAEMDLLGSLSDV
BAD19387.1      PRGSVP------------------------DTSPPVNPSQAVNSLEMDLFG--PDP
EAZ25008.1      PRGSVP------------------------DTSPPVNPSQAVNSLEMDLFG--PDP
EAZ13473.1      PRGF--------------------------STSTTPNVSTPAVPEVDLFADAAFQ
EAY75756.1      ------------------------------TSTATPNVSTPAVPEVDLFADAAFQ
BAD87030.1      PRGFSTSTGTGTTRSNHLDLFGPSLMDDLVDSTTSTSTATPNVSTPAVPEVDLFADAAFQ
SEQID2          PRGTSSN-----------------------KPSTGSANQVDLFGGDLIGDFLDS
CAB87689.1      PRGTSSNSMFLSTTA------------EFADCLSFIREKVGSANQVDLFGGDLIGDFLDS
CAO43767.1      PRGTSST-----------------------KTTAGNINQPDLFGQSLIGDLMDA
CAD41810.2      PRGSSSNG----------------------AAN-TNTSGVDLFAPNLLDDFIDV
EAY95411.1      PRGSSSNG----------------------AAN-TNTSGVDLFAPNLLDDFIDV
AAB68030.1      PRGSSSND----------------------AANNAKTSEVDLFGPNLMDDFMDE
XP_001701452.1  PPGLAD------------------------VPAAGAKAPKKLSEIKINPAVAAT
XP_001419857.1  ------------------------------------------------------------

CAO45312.1      FSSNSLALVPSGPATTTSEAAVLGNAGSAP-ASAAMPSG----SASFED--PFGD-SPFR
CAN66991.1      FSSNSLALVPSGPATTTSEAAVLGNAGSAP-ASAAKPSGSAVMSQSFED--PFGD-SPFR
ABN08674.1      FSSNALPLVPATSGISTPEA----NTGSTA-SFAAPSSGSNNFNQSFED--PFGD-SPFK
NP_850387.1     FSSNALAIVPADSIYVETNG--QANAGPAP-SFSTSQPS----TQSFDD--PFGD-SPFK
BAD44158.1      FSSNALAIVPADSIYVETNG--QANAGPAP-SFSTSQPS----TQSFDD--PFGD-SPFK
BAF01674.1      FSSNALAIVPADSIYVETNG--QANAGPAP-SFSTSQPS----TQSFDD--PFGD-SPFK
AAN72258.1      FSSNALAIVPADSIYVETNG--QANAGPAP-SFSTSQPS----TQSFDD--PFGD-SPFK
AAC64305.1      ------------------------------------------------------------
CAB91599.1      FSPNPLAIVTSDSTSVETNG--QANTGLAP-SFSTSQSS----TQPFDD--PFGD-SPFK
AAL24360.1      FSPNPLAIVTSDSTSVETNG--QANTGLAP-SFSTSQSS----TQPFDD--PFGD-SPFK
BAD19387.1      INSLALVSVPQPTASPNVEP--SANPGFESNSFMGMPPASTGFNEAFDATNPFGDPTPFK
EAZ25008.1      INSLALVSVPQPTASPNVEP--SANPGFESNSFMGMPPASTGFNEAFDATNPFGDPTPFK
EAZ13473.1      SANAPLEAATVSHTQDKIDLFAGRLSSADSFTSDTEFSVRGSPNKSSEKKMSSVVHPSTS
EAY75756.1      SANAPLEAATVSHTQDKIDLFAGRLSSADSFTSDTEFSVRGSPNKSSEKKMSSVVHPSTS
BAD87030.1      SANAPLEAATVSHTQDKIDLFAGRLSSADSFTSDTEFSVRGSPNKSSEKKMSSVVHPSTS
SEQID2          -GPTETSSTNNNENFQEADLFA----------DAAFVS---ASAQGAEFG-SQTQKQVD
CAB87689.1      -GPTETSSTNNNENFQEADLFA----------DAAFVS---ASAQGAEFG-SQTQKQVD
CAO43767.1      PAPVPTEMSAINSNSAEPDLFA----------DATFVS---APPHVEEGSSSQVEAKVD
CAD41810.2      PAAATHETN--DSADAQVDLFA----------DADFQS---AIPSTETAAGSDVQGNVD
EAY95411.1      PAAATHETN--DSADAQVDLFA----------DADFQS---AIPSTETAAGSDVQGNVD
AAB68030.1      P-AATPATK--GVVEPQVDLFG----------DADFQS---ATPSAETAAHQDVQDNVD
XP_001701452.1  FASMPIAPPPSGATIGKLAPPPGAGGAAKP-----------PLPLPAASNTLDLFGELS
XP_001419857.1  ------------------------------------------------------------
```

FIGURE 4 (continued)

```
CAO45312.1        ALPSAESVPAEPQDSASTTSFQT---------------------------------------
CAN66991.1        ALPSAESVPAQPQDSASTTSFQT---------------------------------------
ABN08674.1        ADTSVETAPSQHHAPQTTEPSQSDGFNADMSNFGFGDSFSIVPYSASAPSDTQPFSANSQ
NP_850387.1       AFTSTDTDSTPQQNFG--ASFQP---------------------------------------
BAD44158.1        AFTSTDTDSTPQQNFG--ASFQP---------------------------------------
BAF01674.1        AFTSTDTDSTPQQNFG--ASFQP---------------------------------------
AAN72258.1        AFTSTDTDSTPQQNFG--ASFQP---------------------------------------
AAC64305.1        ------------------------------------------------------------
CAB91599.1        AITSADTETSQHQSFG--VPFQP---------------------------------------
AAL24360.1        AITSADTETSQHQSFG--VPFQP---------------------------------------
BAD19387.1        AVHEETPAVSQTNAAPAGSFHAT---------------------------------------
EAZ25008.1        AVHEETPAVSQTNAAPAGSFHAT---------------------------------------
EAZ13473.1        AFDPFK-QSFATSFPSDSEFSVH---------------------------------------
EAY75756.1        AFDPFK-QSFATSFPSDAEFSVH---------------------------------------
BAD87030.1        AFDPFK-QSFATSFPSDSEFSVH---------------------------------------
SEQID2            LFSASEPSVTVSSAPPTVDLFAS---------------------------------------
CAB87689.1        LFSASEPSVTVSSAPPTVDLFAS---------------------------------------
CAO43767.1        LFGSQ--PAGPSANPPAFDFFAA---------------------------------------
CAD41810.2        LFAEQ--PAFTAAFPPQTGFIPP---------------------------------------
EAY95411.1        LFAEQ--PAFTAAFPPQTGFIPP---------------------------------------
AAB68030.1        LFAGN--ATFASAFPSQTGFIPP---------------------------------------
XP_001701452.1    GPTSSQPAQSQPAASAASDWDAFG--------------------------------------
XP_001419857.1    ------------------------------------------------------------

CAO45312.1        -MNQTS---------GPPFPVTQGVDTGSNFDFGDTFPGITYT------PSG-------
CAN66991.1        -MNQTS---------GPPFPVTQGVDTGSNFDFGDTFPGITYT------PSG-------
ABN08674.1        FLSQDSETDILADILPPAPLPEITSQQNSSAPSFGQPSPSFSTSSGSFSEPTGQLTLHQG
NP_850387.1       --------------PPPAFTSEVSHPDTAHNFGFGDSFSAVANP------DPA-------
BAD44158.1        --------------PPPAFTSEVSHPDTAHNFGFGDSFSAVANP------DPA-------
BAF01674.1        --------------PPPAFTSEVSHPDTAHNFGFGDSFSAVANP------DPA-------
AAN72258.1        --------------PPPAFTSEVSHPDTAHNFGFGDSFSAVANP------DPA-------
AAC64305.1        ------------------------------------------------------------
CAB91599.1        --------------TPP-----TSNPNNEHNFGFGEAFSAVTDS------EPG-------
AAL24360.1        --------------TPP-----TSNPNNEHNFGFGEAFSAVTDS------EPG-------
BAD19387.1        --------------EPAADANPFQPASAASFGFGDTLGDLSFGSN---AAPGQQDIFVP
EAZ25008.1        --------------EPAADANPFQPASAASFGFGDTLGDLSFGSN---AAPGQQDIFVP
EAZ13473.1        -----------------DPTSKSSQGKTPTPE-HSSTAAFDP----------------
EAY75756.1        -----------------DPTSKSSQGKTPTPE-HSSTAAFDP----------------
BAD87030.1        -----------------DPTSKSSQGKTPTPE-HSSTAAFDP----------------
SEQID2            -----------------SESVVSPEAKISIPESMATPNIVDP---------------
CAB87689.1        -----------------SESVVSPEAKISIPESMATPNIVDP---------------
CAO43767.1        -----------------PDPVVQSETKSQKSD-TASPDIVDP---------------
CAD41810.2        -----------------PSSGTS-EANTSTSK-NTTPEPFDP---------------
EAY95411.1        -----------------PSSGTS-EANTSTSK-NTTPEPFDP---------------
AAB68030.1        -----------------PSSGTSSSANSFVSK-KTVPEPFDP---------------
XP_001701452.1    ----------------SAPAVAPAPAAAPAAPVDPFAVLASG---------------
XP_001419857.1    ------------------------------------------------------------
```

FIGURE 4 (continued)

```
CAO45312.1      --VSTAQPPSASPQFSPQEQWIPQQNNDILADILPPSGSSAPAIS-------QAAFPAPT
CAN66991.1      --VSTAQPPSASPQFSPQEQWFPQQNNDILADILPPSGSSAPAIS-------QAAFPAPT
ABN08674.1      FSAATNQPAQTLPTGQFSQPGFSASNSSFSASTSPYAQQPFPSHSG---QPGMPGFSSST
NP_850387.1     --SQNVQPPSNSPGFPQEQFATSQSGIDILAGILPPSGPPVQSGP----SIPTSQFPPSG
BAD44158.1      --SQNVQPPSNSPGFPQEQFATSQSGIDILAGILPPSGPPVQSGP----SIPTSQFPPSG
BAF01674.1      --SQNVQPPSNSPGFPQEQFATSQSGIDILAGILPPSGPPVQSGP----SIPTSQFPPSG
AAN72258.1      --SQNVQPPSNSPGFPQEQFATSQSGIDILAGILPPSGPPVQSGP----SIPTSQFPPSG
AAC64305.1      ------------------------------------------------------------
CAB91599.1      --VQNMQAPPNLSVFPQEQFDTSQSEIDILAGILPPSGPPVSLSPQPDSTMPTSQFHPNG
AAL24360.1      --VQNMQAPPNLSVFPQEQFDTSQSEIDILAGILPPSGPPVSLSPQPDSTMPTSQFHPNG
BAD19387.1      TSSHSEVPPANPSVHPEQAVPSYVSSQAPQPAAAGPQTHAAPASFAS--QAPPTSFASQA
EAZ25008.1      TSSHSEVPPANPSVHPEQAVPSYVSSQAPQPAAAGPQTHAAPASFAS--QAPPTSFASQA
EAZ13473.1      --FAAIPLKSFDGSESFGTFSSNTAS-NITELPRDSSGGPKSSDHGPLEDANFDAFTSHL
EAY75756.1      --FAAIPLKSFDGSESFGTFSSNTAS-NITELQRDSSGGPKSSDHGPLEDANFDAFTSHL
BAD87030.1      --FAAIPLKSFDGSESFGTFSSNTAS-NITELPRDSSGGPKSSDHGPLEDANFDAFTSHL
SEQID2          --FAAVPMDNFDGSDPFGAFTSHSASVSTGP-QAPSVHGSATNTTSPLSFADS-------
CAB87689.1      --FAAVPMDNFDGSDPFGAFTSHSASVSTGP-QAPSVHGSATNTTSPLSFADS-------
CAO43767.1      --FAAVPLNSFDGSDLFGSFTSHTNSASTEP-TQSPANDGNLNNLNGKSSAEF-------
CAD41810.2      --FGAIPINSFDGSDPFGAFNSDVGSSSIPPPTQSSVGNISTPSQNPQAASDFGGFVSST
EAY95411.1      --FGAIPINSFDGSDPFGAFNSDVGSSSIPPPTQSSVGNISTPSQNPQAASDFGGFVSST
AAB68030.1      --FGDIPLSSFGGSDPFGDFSSNVGSSTAPPAVHNSTGNISTPSQNSQAASDFGAFESNT
XP_001701452.1  ---PTAATATSGGSASLGGFKPAVATHASTSSKPGVPPPLSFDDFAELPAAPPAAGADPF
XP_001419857.1  ------------------------------------------------------------

CAO45312.1      GQSVQPNPNVVGG------------------------FLAQS--------------
CAN66991.1      GQSVQPNPNVVGG------------------------FLAQS--------------
ABN08674.1      GHSMQPPFASQGGQSTAQTSGHTYGGLYSLDTSLTPGAPNMYSQSQNGYNGSMNSGNYL-
NP_850387.1     NNMYEGFHSQPPVSTAPNLPGQTPFGQAVQPYNMVPHSQNMTGAMPFNSGGFMHQPG---
BAD44158.1      NNMYEGFHSQPPVSTAPNLPGQTPFGQAVQPYNMVPHSQNMTGAMPFNSGGFMHQPG---
BAF01674.1      NNMYEGFHSQPPVSTAPNLPGQTPFGQAVQPYNMVPHSQNMTGAMPFNSGGFMHQPG---
AAN72258.1      NNMYEGFHSQPPVSTAPNLPGQTPFGQAVQPYNMVPHSQNMTGAMPFNSGGFMHQPG---
AAC64305.1      ------------------------------------------------------------
CAB91599.1      N-SYESYHHQAAP-TDLNMQGQTPFGQASQQFNMVSHSQNHHEGMQFNNGGFTQQPGYAG
AAL24360.1      N-SYESYHHQAAP-TDLNMQGQTPFGQASQQFNMVSHSQNHHEGMQFNNGGFTQQPGYAG
BAD19387.1      PQAGAPYPQAASTFPHSQASHPAATNPSTIPQNVATPFAPLQMPQPVPSGQSNYFMQPVP
EAZ25008.1      PQAGAPYPQAASTFPHSQASHPAATNPSTIPQNVATPFAPLQMPQPVPSGQSNYFMQPVP
EAZ13473.1      GSSTTSATESMNKP----------------------------------------------
EAY75756.1      GSSTTSATESMNKP----------------------------------------------
BAD87030.1      GSSTTSATESMNKP----------------------------------------------
SEQID2          ------------------------------------------------------------
CAB87689.1      ------------------------------------------------------------
CAO43767.1      ------------------------------------------------------------
CAD41810.2      VETAAKDPFDFSSS----------------------------------------------
EAY95411.1      VETAAKDPFDFSSS----------------------------------------------
AAB68030.1      GG-AAKDPFDFSSGG---------------------------------------------
XP_001701452.1  AALASGGSAAASRP----------------------------------------------
XP_001419857.1  ------------------------------------------------------------
```

FIGURE 4 (continued)

```
CAO45312.1        ------------------------------GSADHAAS-------------------
CAN66991.1        ------------------------------GSADHAAS-------------------
ABN08674.1        ----------------------------PQGSSTGFPS-------------------
NP_850387.1       ------------------------------SQTPYS---------------------
BAD44158.1        ------------------------------SQTPYS---------------------
BAF01674.1        ------------------------------SQTPYS---------------------
AAN72258.1        ------------------------------SQTPYS---------------------
AAC64305.1        ----------------------------------------------------------
CAB91599.1        PATSQPPQYTPGVSSHPPSESFPHQPGSATSASSQTPYATTPNVSAGQFDGGSFMTQQPY
AAL24360.1        PATSQPPQYTPGVSSHPPSESFPHQPGSATSASSQTPYATTPNVSAGQFDGGSFMTQQPY
BAD19387.1        G-------------------------TGINGMSGAPS--------------------
EAZ25008.1        G-------------------------TGINGMSGAPS--------------------
EAZ13473.1        ----------------------------------------------------------
EAY75756.1        ----------------------------------------------------------
BAD87030.1        ----------------------------------------------------------
SEQID2            ----------------------------------------------------------
CAB87689.1        ----------------------------------------------------------
CAO43767.1        ----------------------------------------------------------
CAD41810.2        ----------------------------------------------------------
EAY95411.1        ----------------------------------------------------------
AAB68030.1        ----------------------------------------------------------
XP_001701452.1    ----------------------------------------------------------
XP_001419857.1    ----------------------------------------------------------

CAO45312.1        --------------------------------------------------QFSPQIPTG-
CAN66991.1        --------------------------------------------------QFSPQIPTG-
ABN08674.1        --------------------------------------------------QMTPQAPTA-
NP_850387.1       ----------------------------------------------------TPSGPAG-
BAD44158.1        ----------------------------------------------------TPSGPAG-
BAF01674.1        ----------------------------------------------------TPSGPAG-
AAN72258.1        ----------------------------------------------------TPSGPAG-
AAC64305.1        ----------------------------------------------------------
CAB91599.1        GVTQQVHVVPSHIPQRTQSGPVAAFGNNNNIVGDMHQPGSTPSSSSQTPYPTTPNAPSGQ
AAL24360.1        GVTQQVHVVPSHIPQRTQSGPVAAFGNNNNIVGDMHQPGSTPSSSSQTPYPTTPNAPSGQ
BAD19387.1        ---------------------------------------------------QNGAPSYI
EAZ25008.1        ---------------------------------------------------QNGAPSYI
EAZ13473.1        ----------------------------------------------------------
EAY75756.1        ----------------------------------------------------------
BAD87030.1        ----------------------------------------------------------
SEQID2            ----------------------------------------------------------
CAB87689.1        ----------------------------------------------------------
CAO43767.1        ----------------------------------------------------------
CAD41810.2        ----------------------------------------------------------
EAY95411.1        ----------------------------------------------------------
AAB68030.1        ----------------------------------------------------------
XP_001701452.1    ----------------------------------------------------------
XP_001419857.1    ----------------------------------------------------------
```

FIGURE 4 (continued)

```
CAO45312.1        ------PAAQYNN-----GNFLSHGPVTHPSNDNLGGLFPQAGPPGSVMSQSTPPASTGS
CAN66991.1        ------PAAQYNN-----GNFLSQLGSAAP----VPSQAPLQX-PVPSQSPFQSPVPSQS
ABN08674.1        ------QPAQITNFPHHGGSTASPSPTDQASQFNNQSFFGQQGNAAPFSSSYTPQVPAPN
NP_850387.1       ----QFMAHQGHGMP------PSHGPQRTQSGPVTLQGN-NNVMGDMFSQATPNSLTSSS
BAD44158.1        ----QFMALA--------------------------------------------------
BAF01674.1        ----QFMAHQGHGMP------PSHGPQRTQSGPVTLQGN-NNVMGDMFSQATPNSLTSSS
AAN72258.1        ----QFMAHQGHGMP------PSHGPQRTQSGPVTLQGN-NNVMGDMFSQATPNSLTSSS
AAC64305.1        ------------------------------------------------------------
CAB91599.1        FDGGNFMTQQPYGVIPQVHGVPSHIPQRTQSGPVAAHGNSNNVVGDMFSPAGLSSLETSA
AAL24360.1        FDGGNFMTQQPYGVIPQVHGVPSHIPQRTQSGPVAAHGNSNNVVGDMFSPAGLSSLETSA
BAD19387.1        PSQASQFAAPTNLQPSQPTFPPQTAMAASQATSISRGASQPLAVPNSMPSGVNFPLQSSS
EAZ25008.1        PSQASQFAAPTNLQPSQPTFPPQTAMAASQATSISRGASQPLAVPNSMPSGVNFPLQSSS
EAZ13473.1        ------------------------------------------------------------
EAY75756.1        ------------------------------------------------------------
BAD87030.1        ------------------------------------------------------------
SEQID2            ------------------------------------------------------------
CAB87689.1        ------------------------------------------------------------
CAO43767.1        ------------------------------------------------------------
CAD41810.2        ----------------NLGKT---PLADPKADASDFGAFVSHSEEVAKDPFDLSLST
EAY95411.1        ----------------NLGKT---PLADPKADASDFGAFVSHSEEVAKDPFDLSLST
AAB68030.1        ----------------NFGKTNVTPLAAPKTDTSDFGAFVANTAERAKDPFDLSSSI
XP_001701452.1    ------------------------------------------------------------
XP_001419857.1    ------------------------------------------------------------

CAO45312.1        L----------AIVPQASKDKFETKSTVWADTLSRGLVNLNISGA-KINPLADIGIDFDA
CAN66991.1        P----------FQAPVPSQSPFQAPAKIVSS----------YAA-KINPLADIGIDFDA
ABN08674.1        ASPYAVSAAPNSLVSQPSKDKFETKSTVWADTLSRGLVNLNISGP-KTNPLADIGIDFES
NP_850387.1       SHPDLTPLTGAIEIVPPPQKKFEPKSSVWADTLSRGLVNFNISGS-KTNPLADIGVDFEA
BAD44158.1        ------------------------------------------------------------
BAF01674.1        SHPDLTPLTGAIEIVPPPQKKFEPKSSVWADTLSRGLVNFNISGS-KTNPLADIGVDFEA
AAN72258.1        SHPDLTPLTGAIEIVPPPQKKFEPKSSVWADTLSRGLVNFNISGS-KTNPLADIGVDFEA
AAC64305.1        ------------------------------------------------------------
CAB91599.1        SQPSLTPLTGAIEIVPQNQKKFEPKSTIWADTLSRGLVNFNISGP-KTNPLADIGVDFEA
AAL24360.1        SQPSLTPLTGAIEIVPQNQKKFEPKSTIWADTLSRGLVNFNISGP-KTNPLADIGVDFEA
BAD19387.1        SAPPETILSALQVSQSEPVKKFESKSTVWADTLSRGLVNLDISGP-KANPHADIGVDFDS
EAZ25008.1        SAPPETILSALQVSQSEPVKKFESKSTVWADTLSRGLVNLDISGP-KANPHADIGVDFDS
EAZ13473.1        -IKKLGQDSMSASKSVAKKETFQVKSGIWADSLSRGLIDLNITSSQKKVDLSDVGIVGPL
EAY75756.1        -IKKLGQDSMSASKSVAKKETFQVKSGIWADSLSRGLIDLNITSSQKKVDLSDVGIVGPL
BAD87030.1        -IKKLGQDSMSASKSVAKKETFQVKSGIWADSLSRGLIDLNITSSQKKVDLSDVGIVGPL
SEQID2            ----------KPQHLQKKDPFQVKSGIWADSLSRGLIDLNITAP-KKASLADVGVVGDL
CAB87689.1        ----------KPQHLQKKDPFQVKSGIWADSLSRGLIDLNITAP-KKASLADVGVVGDL
CAO43767.1        -----------QP--PPKKDAFQVKSGIWADSLSRGLIDLNISAP-KKINLADVGIVGGL
CAD41810.2        SSGRTNQAPLAAPKSDTKKENFQVKSGIWADSLSRGLIDLNITGP-KKVNLADVGIVGGL
EAY95411.1        SSGRTNQAPLAAPKSDTKKENFQVKSGIWADSLSRGLIDLNITGP-KKVNLADVGIVGGL
AAB68030.1        NNGRTGQTPLAAPKSNTKKENLQVKSSIWADSLSRGLIDLNITGP-KKVNLADVGIVGGL
XP_001701452.1    --------AVPAPAPAAAFDPFAPAPSTMATAPATSSGFGDFMSGNRSSSHASSGGAASS
XP_001419857.1    ------------------------------------------------------------
```

FIGURE 4 (continued)

```
CAO45312.1      INRKEKRMEKPKPATTAPVSTTTMGKAMGSGSGMGRAGAGALRPPPNTMMGS---GMGM-
CAN66991.1      INRKEKRMEKPKPATTAPVSTTTMGKAMGSGSGMGRAGAGALRPPPNTMMGSG-MGMGM-
ABN08674.1      INRKEKRMEKP--TNTPVTSTVNMGKAMGSGSGIGRAGAGALRPNPNSMMGS---GMGM-
NP_850387.1     INRREKRLEK--QTNTPATSTINMGKAMGSGTGLGRSGATAMRPPPNPMTGSG-MPMGG-
BAD44158.1      ------------------------------------------------------------
BAF01674.1      INRREKRLEK--QTNTPATSTINMGKAMGSGTGLGRSGATAMRPPPNPMTGSG-MPMGG-
AAN72258.1      INRREKRLEK--QTNTPATSTINMGKAMGSGTGLGRSGATAMRPPPNPMTGSG-MPMGG-
AAC64305.1      ------------------------------------------------------------
CAB91599.1      INRKEKRLEKPTITQQQVTSTINMGKAMGSGTGLGRAGAGAMRPPTNSMVGSS-MPTG--
AAL24360.1      INRKEKRLEKPTITQQQVTSTINMGKAMGSGTGLGRAGAGAMRPPTNSMVGSS-MPTG--
BAD19387.1      INRKEKRQEKK-VSQAPVVSTITMGKAMGTGSSGIGRAGASAMAPPANPMGASRGIGMGMG
EAZ25008.1      INRKEKRQEKK-VSQAPVVSTITMGKAMGTGSSGIGRAGASAMAPPANPMGASRGIGMGMG
EAZ13473.1      SG--------GSEDKGP---GATMG----TAPGLVSSSFPSKTETSSG------------
EAY75756.1      SG--------GSEDKGPWYMGATMG----TAPGLVSSSFPSKTETSSGSAHFQHHSLEAL
BAD87030.1      SG--------GSEDKGP---GATMG----TAPGLVSSSFPSKTETSSG------------
SEQID2          SN--------EDGNKAS-AASYYSGWSMGAGSGLGKTGLYSTQQQQQQQQQQAPDI---
CAB87689.1      SN--------EDGNKAS-AASYYSGWSMGAGSGLGKTGLYSTQQQQQQQQQQAPDI---
CAO43767.1      SDGS------DEREKGP-QTSFSMGQAMGIGSGLGKSGFTSPPTGGVG------------
CAD41810.2      DD--------GSDDKA--LPSWTMG---AGGSSLGMSGIPSSTQ----------------
EAY95411.1      DD--------GSDDKA--LPSWTMG---AGGSSLGMSGIPSSTQ----------------
AAB68030.1      GD--------GSDDKAH-QPSWNMG---GGGIWSRDVWNPSIYT----------------
XP_001701452.1  GG---------------ATMAMNKAGAAHGAAGQKSNDPFAGLGF---------------
XP_001419857.1  ------------------------------------------------------------

CAO45312.1      --GMGMGSGPGAGMSMGMGGGPGSGMGMGMGGAPGVGMGMGMGGAPAAA-------GMGM
CAN66991.1      --GMGMGSGPGAGMSMGMGGGPGSGMGMGMGGAPGVGMGMGMGGAPAAAG-----MGMGM
ABN08674.1      --GMGMGNAPGG---MGMGNAPG---GMGMG-----GYGGGMNPS-----------MGM
NP_850387.1     --GMGVGSYGGMNQNQPMGMGMGAGMNQNQP------MGMGMGP------------GMNM
BAD44158.1      ------------------------------------------------------------
BAF01674.1      --GMGVGSYGGMNQNQPMGMGMGAGMNQNQP------MGMGMGP------------GMNM
AAN72258.1      --GMGVGSYGGMNQNQPMGMGMGAGMNQNQP------MGMGMGP------------GMNM
AAC64305.1      ------------------------------------------------------------
CAB91599.1      ---MNVGGYGGMNQHQPIGMNQNHPMGMNQN------LSMGMNQNYPMGMNQNYPMGMGM
AAL24360.1      ---MNVGGYGGMNQHQPIGMNQNHPMGMNQN------LSMGMNQNYPMGMNQNYPMGMGM
BAD19387.1      AAGSGYGGGMGMNRPMGMGMGMNQQMGMGMGMN---QQAMGMGMNQQAMGMGMNQQPMGM
EAZ25008.1      AAGSGYGGGMGMNRPMGMGMGMNQQMGMGMN---QQAMGMGINQQAMGMGMNQQPMGM
EAZ13473.1      --------------SEYFLEHSYSSMPIRVNVYIATKLCAMIRRRVAN------------
EAY75756.1      SDFYPGYVFCSMVLAEYFLEHSYSSMPIRVNVYIATKLSAMIRRRVAN------------
BAD87030.1      --------------SGHFQHQQFGSFK---------------------------------
SEQID2          ----------SDDFFSSLSNQRYQSGGFKQ------------------------------
CAB87689.1      ----------SDDFFSSLSNQRYQSGGFKQ------------------------------
CAO43767.1      ----------GDDIFSSLGSQQYQFGGFKK------------------------------
CAD41810.2      -----------SGGIESLANYNKYQFGFK-------------------------------
EAY95411.1      -----------SGGIESLANYNKYQFGFK-------------------------------
AAB68030.1      -----------RRRHRELGELQQVPVWLQMSVQARAFVVFWCSCCRAVKCILISFLLLYT
XP_001701452.1  ------------------------------------------------------------
XP_001419857.1  ------------------------------------------------------------
```

FIGURE 4 (continued)

```
CAO45312.1      GMGMGGGMGMGGYGGMNQPMGMGMNVGMGMNMGMGQGAQMQQPTGLPPGGYNP-------
CAN66991.1      GMGMGGGMGMGGYGGMNQPMGMGMNV--GMNMGMGQGAQMQQPTGLPPGGYNP-------
ABN08674.1      GMGMGG----------------------MGMGQGYQMQPPNGMPPGSNMPG--NYNN
NP_850387.1     NMNMGG----------------------YGQGYPMQPQNPGMVPSPNMPG---NNYN
BAD44158.1      ------------------------------------------------------------
BAF01674.1      NMNMGG----------------------YGQGYPMQPQNPGMVPSPNMPG---NNYN
AAN72258.1      NMNMGG----------------------YGQDYPMQPQNPGMVPSPNMPG---NNYN
AAC64305.1      ------------------------------------------------------------
CAB91599.1      NMNMGG----------------------YGQGYPMQPQQGMGMAPPGAPQGMTGAYN
AAL24360.1      NMNMGG----------------------YGQGYPMQPQQGMGMAPPGAPQGMTGAYN
BAD19387.1      NMGMG-----------------------MNQGMGMNRPPMGMGPGSGYN-------
EAZ25008.1      NMGMG-----------------------MNQGMGMNRPPMGMGPGSGYN-------
EAZ13473.1      ------------------------------------------------------------
EAY75756.1      ------------------------------------------------------------
BAD87030.1      ------------------------------------------------------------
SEQID2          ------------------------------------------------------------
CAB87689.1      ------------------------------------------------------------
CAO43767.1      ------------------------------------------------------------
CAD41810.2      ------------------------------------------------------------
EAY95411.1      ------------------------------------------------------------
AAB68030.1      SVLVISLCYL--------------------------------------------------
XP_001701452.1  ------------------------------------------------------------
XP_001419857.1  ------------------------------------------------------------

CAO45312.1      -MMGSGGYAPQQ--PYGGGYR
CAN66991.1      -MMGSGGYAPQQ--PYGGGYR
ABN08674.1      NMMRPGGYA-QQ--PYGG-YR
NP_850387.1     PMMGQGGYNPQQ--SYGGGYR
BAD44158.1      --------------------
BAF01674.1      PMMGQGGYNPQQ--SYGGGYR
AAN72258.1      PMMGQGGYNPQQ--SYGGGYR
AAC64305.1      --------------------
CAB91599.1      PMMGQGGYNPQQQQPYGGGYR
AAL24360.1      PMMGQGGYNPQQQQPYGGGYR
BAD19387.1      -PMGT-GYGGQQ--PYGG-YR
EAZ25008.1      -PMGT-GYGGQQ--PYGG-YR
EAZ13473.1      --------------------
EAY75756.1      --------------------
BAD87030.1      --------------------
SEQID2          --------------------
CAB87689.1      --------------------
CAO43767.1      --------------------
CAD41810.2      --------------------
EAY95411.1      --------------------
AAB68030.1      --------------------
XP_001701452.1  --------------------
XP_001419857.1  --------------------
```

FIGURE 4 (continued)

SEQ ID NO: 43, NM_121209.5| Arabidopsis thaliana (EPSIN1); binding (AT5G11710) mRNA, complete cds
ATCGGTTCTAGCTGCTAACTTTTTATTTGTTGTTGCCTTTCATTGAAAAAAAAAAAACTCATAATA
CAAAGACGAGCCATCTCTGATTAGATCTACACTTCTCCTCGCACCAAAATTTTGCCAGTTTTCGTT
CCTTTGTTCATAACATTTTCGCGGATTCCAAATGGATTTCATGAAGGTCTTCGATCAAACTGTTCG
AGAGATAAAAAGGGAGGTGAATCTGAAAGTTTTGAAGGTCCCTGAGATGGAGCAAAAGGTATTGGA
TGCTACAGATAATGAGCCTTGGGGTCCCCATGGTACTGCATTGGCAGAGATAGCTCAGGCCACGAA
GAAATTCTCGGAGTGCCAGATGGTTATGAGTGTTTTGTGGACTAGACTAAGTGAGACAGGAAAAGA
TTGGCGATATGTCTACAAGGCATTGGCTGTTATTGATTATCTGATTTCGAATGGATCAGAACGAGC
GGTTGATGAGATTATTGAGCATACTTACCAAATATCTTCACTCACAAGTTTTGAGTATGTTGAACC
AAATGGGAAAGATGTGGGAATCAACGTGAGAAAGAAGGCGGAAAACATAGTCGCTCTTTTAAATAA
TAAAGAGAAAATCTCAGAAATCAGAGACAAAGCAGTAGCAAATCGTAACAAGTATGTTGGCCTCTC
ATCAACGGGAATAACATATAAATCTGGTTCCTCAGCTTCATTTGGTGGTAGTTTTCAAAGTGGTTC
AAGCAATTTTGACAGCTACAAGGATAGAGATTCCAGAGAAGACAAGAATGACTACGAGTCTTTTCA
AAAGTCAAGACGTGGTGTTAAAACTGAGGAGCAAAGCTACACTTCTAAGAAGAGTTTTTCACGCTA
TGGCAGCACGGACCATGACAATCTATCCAGTGGTAAAAAGTCACCCGATTCTGCCAAACATAGGTC
ATATGTATCTGCAGCTCCTTCAAACAACGATGATGATTTTGATGATTTTGATCCACGGGGAACTTC
CAGTAATAAGCCATCCACAGGCAGTGCCAACCAAGTGGACCTTTTTGGAGGAGATCTGATTGGTGA
CTTCTTGGATTCTGGGCCAACAGAAACATCTTCCACCAACAACAACGAGAACTTTCAAGAGGCGGA
CTTGTTTGCTGATGCAGCTTTTGTATCAGCCTCGGCTCAGGGAGCTGAATTTGGGTCACAGACACA
GAAACAAGTTGATCTTTTCTCTGCGTCTGAACCTTCTGTCACAGTTTCTTCAGCTCCTCCGACGGT
TGATCTCTTTGCATCTTCTGAATCAGTTGTAAGCCCAGAAGCCAAGATATCAATACCTGAGTCTAT
GGCTACTCCCAACATTGTTGACCCATTTGCTGCAGTTCCTATGGATAATTTTGATGGATCAGATCC
TTTTGGTGCCTTCACTTCCCACTCGGCTTCAGTTTCTACAGGTCCACAAGCTCCAAGTGTACATGG
GAGTGCAACAAACACCACAAGCCCGCTGTCTTTCGCAGACTCGAAGCCACAACATTTGCAAAAGAA
AGATCCTTTCCAGGTGAAATCAGGAATTTGGGCAGATTCGCTGAGCCGTGGACTGATTGATCTCAA
TATAACTGCTCCCAAAAAAGCTTCTCTAGCTGATGTGGGTGTTGTGGGGGATCTGAGCAATGAAGA
TGGGAACAAAGCATCTGCTGCATCGTACTACTCAGGCTGGTCCATGGGTGCAGGATCCGGGCTTGG
TAAAACTGGCCTATACAGTACACAGCAGCAGCAGCAACAACAACAACAACAAGCACCTGATAT
CTCAGACGATTTCTTCTCCAGCCTCAGTAACCAAAGGTACCAATCTGGTGGCTTTAAGCAGTGAAA
TTGTCTGTGATTTGGTGTTGAGATGAAAAGGCATATCAAGTTTGATTCTACATTCCATACTGGAAA
TGTAAGTTTTTTAATGGGTTTGTTGTTCTTGCACTTCATTCATGGGACAATCTGGTCGGTGACTG
ATGTGCCATTGTTGTTGTGGCGTTTACTTTGGGTTTAAATGAGAGAGAGAAGAATTGTCTTTATGT
TTTTTTTGATAAGAGAGTACTTTTATTATTGGTTTAAAGTTTCGATTTGTTCATAGAACAAAAGTA
TATGTATCTCTTCCCACTCAACAAATATTTTTTTATCGCGTGTGATTCTTAATCCGAAAGAGACT
CCAACTTTCTTCTC

SEQ ID NO: 44, NP_196732.2| (EPSIN1); binding [Arabidopsis thaliana]
MDFMKVFDQTVREIKREVNLKVLKVPEMEQKVLDATDNEPWGPHGTALAEIAQATKKFSECQMVMS
VLWTRLSETGKDWRYVYKALAVIDYLISNGSERAVDEIIEHTYQISSLTSFEYVEPNGKDVGINVR
KKAENIVALLNNKEKISEIRDKAVANRNKYVGLSSTGITYKSGSSASFGGSFQSGSSNFDSYKDRD
SREDKNYESFQKSRRGVKTEEQSYTSKKSFSRYGSTDHDNLSSGKKSPDSAKHRSYVSAAPSNND
DDFDDFDPRGTSSNKPSTGSANQVDLFGGDLIGDFLDSGPTETSSTNNNENFQEADLFADAAFVSA
SAQGAEFGSQTQKQVDLFSASEPSVTVSSAPPTVDLFASSESVVSPEAKISIPESMATPNIVDPFA

FIGURE 7

AVPMDNFDGSDPFGAFTSHSASVSTGPQAPSVHGSATNTTSPLSFADSKPQHLQKKDPFQVKSGIW
ADSLSRGLIDLNITAPKKASLADVGVVGDLSNEDGNKASAASYYSGWSMGAGSGLGKTGLYSTQQQ
QQQQQQQQAPDISDDFFSSLSNQRYQSGGFKQ

SEQ ID NO: 45, GOS2 promoter, Oryza sativa
```
AATCCGAAAAGTTTCTGCACCGTTTTCACCCCCTAACTAACAATATAGGGAACGTGTGCTAAATAT
AAAATGAGACCTTATATATGTAGCGCTGATAACTAGAACTATGCAAGAAAAACTCATCCACCTACT
TTAGTGGCAATCGGGCTAAATAAAAAAGAGTCGCTACACTAGTTTCGTTTTCCTTAGTAATTAAGT
GGGAAAATGAAATCATTATTGCTTAGAATATACGTTCACATCTCTGTCATGAAGTTAAATTATTCG
AGGTAGCCATAATTGTCATCAAACTCTTCTTGAATAAAAAAATCTTTCTAGCTGAACTCAATGGGT
AAAGAGAGAGATTTTTTTAAAAAAATAGAATGAAGATATTCTGAACGTATTGGCAAAGATTTAAA
CATATAATTATATAATTTTATAGTTTGTGCATTCGTCATATCGCACATCATTAAGGACATGTCTTA
CTCCATCCCAATTTTTATTTAGTAATTAAAGACAATTGACTTATTTTTATTATTTATCTTTTTCG
ATTAGATGCAAGGTACTTACGCACACACTTTGTGCTCATGTGCATGTGTGAGTGCACCTCCTCAAT
ACACGTTCAACTAGCAACACATCTCTAATATCACTCGCCTATTTAATACATTTAGGTAGCAATATC
TGAATTCAAGCACTCCACCATCACCAGACCACTTTTAATAATATCTAAAATACAAAAAATAATTTT
ACAGAATAGCATGAAAAGTATGAAACGAACTATTTAGGTTTTTCACATACAAAAAAAAAAAGAATT
TTGCTCGTGCGCGAGCGCCAATCTCCCATATTGGGCACACAGGCAACAACAGAGTGGCTGCCCACA
GAACAACCCACAAAAAACGATGATCTAACGGAGGACAGCAAGTCCGCAACAACCTTTTAACAGCAG
GCTTTGCGGCCAGGAGAGAGGAGGAGAGGCAAAGAAAACCAAGCATCCTCCTTCTCCCATCTATAA
ATTCCTCCCCCCTTTTCCCCTCTCTATATAGGAGGCATCCAAGCCAAGAAGAGGGAGAGCACCAAG
GACACGCGACTAGCAGAAGCCGAGCGACCGCCTTCTCGATCCATATCTTCCGGTCGAGTTCTTGGT
CGATCTCTTCCCTCCTCCACCTCCTCCTCACAGGGTATGTGCCTCCCTTCGGTTGTTCTTGGATTT
ATTGTTCTAGGTTGTGTAGTACGGGCGTTGATGTTAGGAAAGGGGATCTGTATCTGTGATGATTCC
TGTTCTTGGATTTGGGATAGAGGGGTTCTTGATGTTGCATGTTATCGGTTCGGTTTGATTAGTAGT
ATGGTTTTCAATCGTCTGGAGAGCTCTATGGAAATGAAATGGTTTAGGGATCGGAATCTTGCGATT
TTGTGAGTACCTTTTGTTTGAGGTAAAATCAGAGCACCGGTGATTTTGCTTGGTGTAATAAAGTAC
GGTTGTTTGGTCCTCGATTCTGGTAGTGATGCTTCTCGATTTGACGAAGCTATCCTTTGTTTATTC
CCTATTGAACAAAAATAATCCAACTTTGAAGACGGTCCCGTTGATGAGATTGAATGATTGATTCTT
AAGCCTGTCCAAAATTTCGCAGCTGGCTTGTTTAGATACAGTAGTCCCCATCACGAAATTCATGGA
AACAGTTATAATCCTCAGGAACAGGGGATTCCCTGTTCTTCCGATTTGCTTTAGTCCCAGAATTTT
TTTTCCCAAATATCTTAAAAAGTCACTTTCTGGTTCAGTCAATGAATTGATTGCTACAAATAATG
CTTTTATAGCGTTATCCTAGCTGTAGTTCAGTTAATAGGTAATACCCCTATAGTTTAGTCAGGAGA
AGAACTTATCCGATTTCTGATCTCCATTTTTAATTATATGAAATGAACTGTAGCATAAGCAGTATT
CATTTGGATTATTTTTTTATTAGCTCTCACCCCTTCATTATTCTGAGCTGAAAGTCTGGCATGAA
CTGTCCTCAATTTTGTTTTCAAATTCACATCGATTATCTATGCATTATCCTCTTGTATCTACCTGT
AGAAGTTTCTTTTTGGTTATTCCTTGACTGCTTGATTACAGAAAGAAATTTATGAAGCTGTAATCG
GGATAGTTATACTGCTTGTTCTTATGATTCATTTCCTTTGTGCAGTTCTTGGTGTAGCTTGCCACT
TTCACCAGCAAAGTTC
```

SEQ ID NO: 46, prm09481
```
GGGGACAAGTTTGTACAAAAAAGCAGGCTTAAACAATGGATTTCATGAAGGTCTTC
```

FIGURE 7 (CONTINUED)

SEQ ID NO: 47, prm09482
GGGGACCACTTTGTACAAGAAAGCTGGGTTCACAGACAATTTCACTGCTT

SEQ ID NO: 48, motif 1
(V/I)(L/R)(D/E)AT(S/D/N)(N/D/E/S)E(P/S)WGPHG(T/S/E)

SEQ ID NO: 49, motif 2
F(Q/E)(Y/F)(I/L/V/R/K)(D/E)(S/P/A)(S/G/N/Q/R)G(R/K)D(Q/V/A/H/E)G(S/N/L/I/V)NVR

SEQ ID NO: 50, motif 3
(E/S/A/Q)(V/I/E/A)R(Q/E/D/N)KA(A/L/V/E)(A/V/S/R/K)(N/T)(R/A)(D/E/N/G)K

SEQ ID NO: 51, motif 4
WAD(T/S)LSRGL(V/I)

SEQ ID NO: 52, motif 5
L(A/S)D(I/V)G(I/V)(D/V)(F/G)(D/E/P/G)

SEQ ID NO: 53, motif 6a
GGYG

SEQ ID NO: 54, motif 6b
GSYG

SEQ ID NO: 55, motif 6c
GGYD

SEQ ID NO: 56 motif 7a
SAAS

SEQ ID NO: 57, motif 7b
SSAS

SEQ ID NO: 58, motif 7c
SSAP

SEQ ID NO: 59, motif 7d
SSAT

SEQ ID NO: 60, motif 8a
DEFD

SEQ ID NO: 61, motif 8b,
DFFD

FIGURE 7 (continued)

SEQ ID NO: 62, motif 8c,
DDDF

SEQ ID NO: 63, motif 8d
EDDF

SEQ ID NO: 64, motif 8e
DDFD

SEQ ID NO: 65 , (gi|7573375:51963-52003, 52095-52146, 52534-52613, 52702-52780, 52869-52952, 53040-53185, 53272-53490, 53706-53902, 53984-54162, 54358-54763, 55048-55298) Arabidopsis thaliana DNA chromosome 5, BAC clone T22P22 (ESSA project)
ATGGATTTCATGAAGGTCTTCGATCAAACTGTTCGAGAGATAAAAAGGGAGGTGAATCTGAAAGTT
TTGAAGGTCCCTGAGATGGAGCAAAAGGTATTGGATGCTACAGATAATGAGCCTTGGGGTCCCCAT
GGTACTGCATTGGCAGAGATAGCTCAGGCCACGAAGAAATTCTCGGAGTGCCAGATGGTTATGAGT
GTTTTGTGGACTAGACTAAGTGAGACAGGAAAAGATTGGCGATATGTCTACAAGGCATTGGCTGTT
ATTGATTATCTGATTTCGAATGGATCAGAACGAGCGGTTGATGAGATTATTGAGCATACTTACCAA
ATATCTTCACTCACAAGTTTTGAGTATGTTGAACCAAATGGGAAAGATGTGGGAATCAACGTGAGA
AAGAAGGCGGAAAACATAGTCGCTCTTTTAAATAATAAAGAGAAAATCTCAGAAATCAGAGACAAA
GCAGTAGCAAATCGTAACAAGTATGTTGGCCTCTCATCAACGGGAATAACATATAAATCTGGTTCC
TCAGCTTCATTTGGTGGTAGTTTTCAAAGTGGTTCAAGCAATTTTGACAGCTACAAGGATAGAGAT
TCCAGAGAAGACAAGAATGACTACGAGTCTTTTCAAAAGTCAAGACGTGGTGTTAAAACTGAGGAG
CAAAGCTACACTTCTAAGAAGAGTTTTTCACGCTATGGCAGCACGGACCATGACAATCTATCCAGT
GGTAAAAAGTCACCCGATTCTGCCAAACATAGGTCATATGTATCTGCAGCTCCTTCAAACAACGAT
GATGATTTTGATGATTTTGATCCACGGGGAACTTCCAGTAATAGTATGTTTCTCTCTACGACTGCT
GAGTTTGCAGATTGTTTATCATTCATTCGGGAGAAAGTTGGCAGTGCCAACCAAGTGGACCTTTTT
GGAGGAGATCTGATTGGTGACTTCTTGGATTCTGGGCCAACAGAAACATCTTCCACCAACAACAAC
GAGAACTTTCAAGAGGCGGACTTGTTTGCTGATGCAGCTTTTGTATCAGCCTCGGCTCAGGGAGCT
GAATTTGGGTCACAGACACAGAAACAAGTTGATCTTTTCTCTGCGTCTGAACCTTCTGTCACAGTT
TCTTCAGCTCCTCCGACGGTTGATCTCTTTGCATCTTCTGAATCAGTTGTAAGCCCAGAAGCCAAG
ATATCAATACCTGAGTCTATGGCTACTCCAACATTGTTGACCCATTTGCTGCAGTTCCTATGGAT
AATTTTGATGGATCAGATCCTTTTGGTGCCTTCACTTCCCACTCGGCTTCAGTTTCTACAGGTCCA
CAAGCTCCAAGTGTACATGGGAGTGCAACAAACACCACAAGCCCGCTGTCTTTCGCAGACTCGAAG
CCACAACATTTGCAAAAGAAAGATCCTTTCCAGGTGAAATCAGGAATTTGGGCAGATTCGCTGAGC
CGTGGACTGATTGATCTCAATATAACTGCTCCCAAAAAAGCTTCTCTAGCTGATGTGGGTGTTGTG
GGGGATCTGAGCAATGAAGATGGGAACAAAGCATCTGCTGCATCGTACTACTCAGGCTGGTCCATG
GGTGCAGGATCCGGGCTTGGTAAAACTGGCCTATACAGTACACAGCAGCAGCAGCAACAACAACAA
CAACAACAAGCACCTGATATCTCAGACGATTTCTTCTCCAGCCTCAGTAACCAAAGGTACCAATCT
GGTGGCTTTAAGCAGTGA FIGURE 7 (continued)

SEQ ID NO: 66, CAB87689.1| clathrin binding protein-like [Arabidopsis thaliana]
MDFMKVFDQTVREIKREVNLKVLKVPEMEQKVLDATDNEPWGPHGTALAEIAQATKKFSECQMVMS
VLWTRLSETGKDWRYVYKALAVIDYLISNGSERAVDEIIEHTYQISSLTSFEYVEPNGKDVGINVR
KKAENIVALLNNKEKISEIRDKAVANRNKYVGLSSTGITYKSGSSASFGGSFQSGSSNFDSYKDRD
SREDKNDYESFQKSRRGVKTEEQSYTSKKSFSRYGSTDHDNLSSGKKSPDSAKHRSYVSAAPSNND
DDFDDFDPRGTSSNSMFLSTTAEFADCLSFIREKVGSANQVDLFGGDLIGDFLDSGPTETSSTNNN
ENFQEADLFADAAFVSASAQGAEFGSQTQKQVDLFSASEPSVTVSSAPPTVDLFASSESVVSPEAK
ISIPESMATPNIVDPFAAVPMDNFDGSDPFGAFTSHSASVSTGPQAPSVHGSATNTTSPLSFADSK
PQHLQKKDPFQVKSGIWADSLSRGLIDLNITAPKKASLADVGVVGDLSNEDGNKASAASYYSGWSM
GAGSGLGKTGLYSTQQQQQQQQQQAPDISDDFFSSLSNQRYQSGGFKQ

SEQ ID NO: 67, (gi|157339171:565799-565839, 565955-566006, 567326-567405, 567533-567611, 567742-567825, 567938-568083, 568192-568289, 568302-568449, 568685-568824, 569004-569200, 570188-570578, 572867-573096) Vitis vinifera chromosome chr4 scaffold_6, whole genome shotgun sequence
ATGGATTTCATGAAAGTCTTCGATCAGACGGTCCGAGAAATAAAGAGGGAGGTGAATCTGAAGGTT
TTGAAGGTTCCAGAGATCGAGCAGAAGGTACTGGATGCAACCGACAATGAACCTTGGGGCCCTCAT
GGCTCTGCCCTGGCAGAAATAGCTCAGGCCACTAAAAAATTCACTGAATGTCAGATGGTTATGAAT
GTTCTGTGGACAAGATTAAGTGATTCTGGCCGAGACTGGCGCCATGTCTATAAGTCACTGGCTGTT
ATAGAGTATTTGGTGGCTAATGGATCTGAACGTGCTGTTGATGATATAATTGAACACACTTTCCAA
ATCTCATCACTTTCAGGATTTGAGTATGTTGAACCAAATGGGAAGGATGTTGGAATCAATGTGAGG
AAGAAGGCTGAAACCATTGTGGCTCTTTTGAATAACAAAGAAAAAATACAAGAAGTTAGAAATAAA
GCTGCTGCAAACCGCGACAAGTTCTTTGGACTTTCCTCATCTGGAGTGACATACAAGTCTAGTTCA
GCCCCATATGGCAGCAGCAGCTTTCAGAGTGCTGATCAGCATGGAGGTATGAAAAATGATTCATTT
AGGGATAGTTATAAAGACAGGGATCGGTTTGATGAAGAAAAGGTCGACGAGGATACTTCTGCTAAG
TCACGTCAAGGGGTTACCAGTGAGAATGAAGGGAACACCTTTAAAAAGGGATCTGCACGCTATAGC
AGCAAGGATAAAGATACTTTGTCAACAAAGGCAAATTACTCTGACAAGTACGGGTCAATTCCCTCC
CACAGTTCAAGTGTGCCTTCAATTAATGATGAAGATGATTTTGATGACTTTGATCCCCGGGGAACT
TCCAGTACCAAGACCACTGCTGGAAACATTAACCAACCAGACCTGTTTGGGCAAAGTTTGATTGGT
GACCTCATGGATGCACCGGCACCTGTTCCCACAGAAATGTCTGCCATCAACAGCAATTCTGCAGAG
CCTGATCTGTTTGCAGATGCAACTTTTGTTTCAGCGCCACCTCATGTAGAAGAAGGTTCTAGTTCT
CAGGTTGAGGCGAAGGTTGATCTATTTGGGTCTCAACCTGCTGGTCCTTCTGCGAATCCTCCAGCA
TTTGACTTTTTTGCTGCCCCTGATCCAGTTGTGCAATCAGAAACCAAGTCTCAAAAATCTGACACA
GCCAGCCCCGACATTGTTGATCCATTTGCTGCAGTTCCACTAAACAGTTTTGATGGATCAGATCTT
TTTGGTTCATTCACTTCCCATACCAACTCTGCATCTACAGAGCCTACACAAAGTCCTGCAAATGAT
GGCAACCTTAACAATTTGAATGGAAAATCCTCTGCAGAATTTCAACCTCCACCCAAGAAGGATGCT
TTCCAGGTTAAATCTGGAATTTGGGCAGATTCACTGAGCCGTGGACTGATTGATCTTAATATATCC
GCACCCAAGAAGATAAATCTAGCAGATGTTGGCATTGTGGGAGGATTGAGTGATGGATCGGATGAA
AGGGAGAAGGGACCCCAAACTTCGTTTTCCATGGGACAAGCCATGGGTATTGGCTCCGGTCTTGGT
AAATCTGGGTTTACATCTCCACCAACAGGTGGAGTTGGTGGAGATGACATCTTCTCAAGTCTCGGC
AGCCAGCAATACCAATTCGGAGGCTTCAAGAAATAA SEQ ID NO: 68, CAO43767.1| unnamed protein product [Vitis vinifera]
MDFMKVFDQTVREIKREVNLKVLKVPEIEQKVLDATDNEPWGPHGSALAEIAQATKKFTECQMVMN
VLWTRLSDSGRDWRHVYKSLAVIEYLVANGSERAVDDIIEHTFQISSLSGFEYVEPNGKDVGINVR
KKAETIVALLNNKEKIQEVRNKAAANRDKFFGLSSSGVTYKSSSAPYGSSSFQSADQHGGMKNDSF
RDSYKDRDRFDEEKVDEDTSAKSRQGVTSENEGNTFKKGSARYSSKDKDTLSTKANYSDKYGSIPS
HSSSVPSINDEDDFDDFDPRGTSSTKTTAGNINQPDLFGQSLIGDLMDAPAPVPTEMSAINSNSAE
PDLFADATFVSAPPHVEEGSSSQVEAKVDLFGSQPAGPSANPPAFDFFAAPDPVVQSETKSQKSDT
ASPDIVDPFAAVPLNSFDGSDLFGSFTSHTNSASTEPTQSPANDGNLNNLNGKSSAEFQPPPKKDA
FQVKSGIWADSLSRGLIDLNISAPKKINLADVGIVGGLSDGSDEREKGPQTSFSMGQAMGIGSGLG
KSGFTSPPTGGVGGDDIFSSLGSQQYQFGGFKK SEQ ID NO: 69, (gi|32492195:55444-55484, 55606-55657, 56304-56383, 56815-56893, 57065-57148, 57252-57397, 57504-57722, 58076-58167, 58573-58763, 58996-59602, 59707-59900) Oryza sativa genomic DNA, chromosome 4, BAC clone: OSJNBa0083N12, complete sequence
ATGGATTTCGTGAAGGTTTTCGATCAGGCCGTGCGGGAGATAAAGAGGGAGGTCAATTTGAAGGTG
CTCAAGGTTCCAGAGCTCGAACAGAAGGTACTTGATGCAACAAGCGATGAACCTTGGGGCCCTCAT
GGTACTACTCTTTCAGAGCTATCACATGCCACCAAGAAGTTCGCTGAATGTCAGATGGTAATGAGT
GTCCTCTGGACTAGGCTGTCTGAGCGAGGCTCGAAATGGCGTCACGTGTATAAGGCTTTGACAATT
ATTGAGTACTTAATAGCCAATGGTTCTGAGCGGGCAGTTGATGACATTCTTGATCACTATTCAAAG
ATCTCGGTTCTTTCAAGTTTTGAATATGTGGAACCTAATGGAAAAGATGCTGGAATAAATGTGAGA
AAGAAAGTCGAAACTATATTGGGACTCATAAATGACAAGGAGAAAATAAAGTCTGTAAGAGAGAAA
GCCGCCAGTAATCGTGACAAGTATGTTGGGCTATCATCGACAGGGATAACATATAAGTCAAGCTCT
GCTTCATTTGGTAGCAACTATAGTTCTGGTGAACGTTATGGGAGTTTTAGTGGTACAAGGGAAGGT
GATTCATACGGTGACAGTTATAGGGATAAAGAACCTGTTAAATCCTCTCCAAGTTATACTGGCAGC
CAGAAATCTGGCAGCAGGATAAAAAAGGATGTGAATAGAAGGAATGAGGATTCACCGAGCTCCTTG
AAGTCTAATGCAAAAGGCAATGAGGACGATTTTGATGATTTTGATCCTCGTGGATCTTCTTCAAAT
GGTGCAGCTAATACAAACACCAGTGGCGTGGATCTTTTTGCCCCAAACTTATTGGATGATTTCATC
GATGTGCCTGCAGCAGCAACTCATGAAACAAACGACTCTGCAGACGCTCAGGTTGATCTGTTTGCT
GATGCAGATTTCCAATCAGCAATACCAAGTACAGAAACAGCTGCGGGTTCAGATGTCCAGGGCAAT
GTAGACCTTTTTGCGGAACAGCCAGCCTTCACAGCAGCCTTTCCACCACAGACAGGGTTTATTCCA
CCACCAAGTTCTGGGACATCTGAAGCAAATACTTCCACGTCTAAGAACACAACTCCTGAACCTTTT
GATCCTTTTGGTGCTATTCCTATAAACAGCTTTGATGGATCTGATCCATTTGGTGCCTTCAACTCC
GATGTTGGATCATCTAGTATACCACCACCCACGCAGAGTTCTGTTGGAAATATCAGCACACCAAGT
CAGAACCCTCAAGCAGCATCTGACTTTGGTGGCTTTGTGTCAGCACTGTAGAAACAGCAGCTAAG
GACCCCTTTGATTTTCAAGTAGCAATCTTGGGAAAACACCTTTGGCAGATCCAAAGGCTGATGCA
TCCGATTTTGGTGCCTTTGTATCGCACAGTGAGGAAGTAGCCAAGGATCCTTTTGATCTTTCTTTG
AGTACCAGCTCTGGAAGGACAAACCAAGCACCTCTGGCGGCTCCCAAGTCAGATACCAAGAAAGAA
AATTTTCAGGTCAAGTCTGGCATATGGGCTGACTCATTGAGCCGTGGACTGATTGATCTGAACATA
ACTGGACCAAAGAAGGTGAACTTAGCCGACGTTGGGATTGTCGGTGGCCTCGATGACGGGTCTGAT
GATAAAGCTCTGCCCTCATGGACCATGGGTGCAGGAGGTTCCAGCCTAGGAATGTCCGGAATTCCT
TCATCTACACAAAGTGGTGGCATTGAGAGCTTAGCTAACTACAACAAGTACCAGTTTGGCTTTAAA
TGA FIGURE 7 (continued)

SEQ ID NO: 70, CAD41810.2| OSJNBa0083N12.8 [Oryza sativa (japonica cultivar-group)]
MDFVKVFDQAVREIKREVNLKVLKVPELEQKVLDATSDEPWGPHGTTLSELSHATKKFAECQMVMS
VLWTRLSERGSKWRHVYKALTIIEYLIANGSERAVDDILDHYSKISVLSSFEYVEPNGKDAGINVR
KKVETILGLINDKEKIKSVREKAASNRDKYVGLSSTGITYKSSSASFGSNYSSGERYGSFSGTREG
DSYGDSYRDKEPVKSSPSYTGSQKSGSRIKKDVNRRNEDSPSSLKSNAKGNEDDFDDFDPRGSSSN
GAANTNTSGVDLFAPNLLDDFIDVPAAATHETNDSADAQVDLFADADFQSAIPSTETAAGSDVQGN
VDLFAEQPAFTAAFPPQTGFIPPPSSGTSEANTSTSKNTTPEPFDPFGAIPINSFDGSDPFGAFNS
DVGSSSIPPPTQSSVGNISTPSQNPQAASDFGGFVSSTVETAAKDPFDFSSSNLGKTPLADPKADA
SDFGAFVSHSEEVAKDPFDLSLSTSSGRTNQAPLAAPKSDTKKENFQVKSGIWADSLSRGLIDLNI
TGPKKVNLADVGIVGGLDDGSDDKALPSWTMGAGGSSLGMSGIPSSTQSGGIESLANYNKYQFGFK SEQ ID NO: 71, (gi|57900560:115542-115582, 115678-115729, 115855-115934, 116079-116157, 116237-116320, 116406-116551, 116637-116903, 117052-117182, 117344-117546, 117819-118434, 118746-118933) Oryza sativa (japonica cultivar-group) genomic DNA, chromosome 1, BAC clone:OSJNBb0021A09
ATGGATTTCAGGAAGGTGCTCGACCAGACCGTCCGGGAGATAAGGAGGGAGGTAAATCTTAAGGTG
CTCAAGGTGCCGGAAATCGAGCAGAAGGTTCTTGATGCCACCAGCGACGAGCCGTGGGGCCGCAT
GGTTCCGATTTGGCAGATATCGCCAGGGCCACCAAGAGCTACGGTGATAGCGAAATTATAATGAAT
GTGTTATGGCAACGCCTGGGGAACACACTTGCGAATTGGCGTCACGTGTATAAGGCGTTGGCTGTG
ATCGAGTACCTTCTAGCTAATGGCACCGAACGTGCAGCTGATGGCATTGTTGACAATAGCTCACGA
ATTGCAAAACTCACAAGATTTGAGTATTTGGAGCCTAATGGAAAAGATGTTGGGCTCAATGTGCGT
AAGAAGGCTGAAGCTGTTCTAGCAATTTTGGATGACAGGGAGAAGCTTCAAGAGGTCAGAGAGAAG
GCTGCCGTTACTAGAGACAAGTATTTTGGCTTATCATCAACTGGAATAACGCACAAATCGAGCGCA
GCATCATTTGGCAGTGGCAGCTACTCATCTGGTAGCCACTATGGGAGCACAGGAGGTTCAAGGGAG
GTGGGATCATTCAAGGATATACACACAGGCACAGAATGGAAAAAGAACAAGAAGGAAACAGTGTCA
AACTACAGCAGCAATAGAGAAGGGTCTAAAGAAATTACTAACAGTGCAACCAGTTATAAGTCAAAA
AAGAGTGAAAGGCATGGTAGAAGAAATCAAAATTCCTTAACATTACACTCGAAGTTATCTGCAAAT
ATTAGCACCACATCTGAAGCCCCAAGCTCAAAGAAAGGGGAAAATGAGGATGATGATGATTTCAAC
CCACGAGGATTTTCTACATCTACTGGAACAGGTACCACAAGATCTAATCACCTGGATCTCTTTGGT
CCAAGCTTGATGGATGATCTTGTTGATTCTACTACATCCACTTCAACAGCAACGCCAAATGTTAGC
ACACCTGCTGTGCCAGAGGTTGATTTATTTGCAGATGCAGCTTTCCAATCAGCCAATGCTCCATTG
GAGGCAGCAACGGTTTCTCACACTCAGGACAAAATTGATTTGTTTGCTGGCAGACTGTCTTCTGCT
GATTCATTTACTTCAGACACAGAGTTCTCAGTACGCGGTAGTCCTAACAAGTCATCGGAGAAAAAA
ATGTCTTCCGTTGTGCATCCTTCTACTTCTGCTTTTGATCCCTTCAAACAATCTTTTGCCACCTCA
TTTCCTTCAGATTCAGAGTTCTCAGTTCATGATCCGACAAGCAAATCTTCTCAAGGAAAAACTCCC
ACACCAGAACATTCAAGTACAGCAGCTTTTGATCCTTTTGCTGCAATTCCACTGAAGAGTTTTGAT
GGATCCGAATCTTTTGGAACATTTTCTTCGAACACAGCCTCAAACATTACTGAACTGCCACGGGAT
TCTTCTGGGGGTCCCAAAAGTTCTGACCATGGTCCTTTGGAGGATGCCAATTTTGATGCCTTCACT
TCACACTTGGGATCTTCCACAACAAGTGCAACTGAGTCCATGAATAAGCCCATCAAAAAGCTTGGG
CAGGACTCGATGTCAGCATCAAAATCAGTTGCAAAGAAAGAAACTTTTCAGGTCAAATCTGGCATA
TGGGCTGACTCTTTGAGCCGAGGATTGATTGATTTGAATATAACTTCGTCACAAAAGAAGGTCGAT
CTCTCCGATGTTGGGATTGTCGGACCGCTGAGCGGCGGATCTGAGGATAAAGGCCCGGGGCGACG
ATGGGCACAGCACCAGGCCTTGTCAGTTCTAGTTTTCCATCTAAAACAGAAACATCCAGTGGAAGC
GGTCATTTTCAGCACCAACAGTTTGGAAGCTTTAAGTGA SEQ ID NO: 72, BAD87030.1| putative enthoprotin [Oryza sativa (japonica cultivar-group)]
MDFRKVLDQTVREIRREVNLKVLKVPEIEQKVLDATSDEPWGPHGSDLADIARATKSYGDSEIIMN
VLWQRLGNTLANWRHVYKALAVIEYLLANGTERAADGIVDNSSRIAKLTRFEYLEPNGKDVGLNVR
KKAEAVLAILDDREKLQEVREKAAVTRDKYFGLSSTGITHKSSAASFGSGSYSSGSHYGSTGGSRE
VGSFKDIHTGTEWKKNKKETVSNYSSNREGSKEITNSATSYKSKKSERHGRRNQNSLTLHSKLSAN
ISTTSEAPSSKKGENEDDDDFNPRGFSTSTGTGTTRSNHLDLFGPSLMDDLVDSTTSTSTATPNVS
TPAVPEVDLFADAAFQSANAPLEAATVSHTQDKIDLFAGRLSSADSFTSDTEFSVRGSPNKSSEKK
MSSVVHPSTSAFDPFKQSFATSFPSDSEFSVHDPTSKSSQGKTPTPEHSSTAAFDPFAAIPLKSFD
GSESFGTFSSNTASNITELPRDSSGGPKSSDHGPLEDANFDAFTSHLGSSTTSATESMNKPIKKLG
QDSMSASKSVAKKETFQVKSGIWADSLSRGLIDLNITSSQKKVDLSDVGIVGPLSGGSEDKGPGAT
MGTAPGLVSSSFPSKTETSSGSGHFQHQQFGSFK SEQ ID NO: 73, gi|1724113:85-2001 Avena fatua Af10-protein mRNA, complete cds
ATGGATTTCATGAAGGTCTTCGATCAGACCGTGCGAGAGATCAAGAGGGAGGTCAACCTGAAGGTG
CTCAAGGTTCCCGAGCTCGAACAGAAGGTGCTTGATGCAACAAGTGATGAACCTTGGGGTCCACAT
GGAAGTGCTCTTTCAGACGTAGCGCAGGCCACCAAGAAATACTCTGAGTGTCAGATGGTAATGGGT
GTCCTTTGGGCTAGGCTTGCTGAGCGAGACTCGAACTGGCGCCATGTGTATAAGGCGCTGACAATT
ATCGAGTACTTGATAGCCAACGGTTCTGAGCGGGCGGTTGATAACATCCTTGATCATTTTTCAAAG
ATCTCGGTTCTTTCGAGTTTTGAGTTTGTGGAACCGAATGGAAAAGATGCTGGAATAAATGTGAGG
AAGAAAGTCGAAACTCTAGTGGGCATCATAAATGACAAGGATAGAATAAAGGCTGTGAGAGATAAA
GCAGCCAGTAACCGTGACAAGTACGTTGGGTTATCCTCAACCGGATCATCATATAGATCAAGCTCA
GCCACTGTAGGGAGCAATTACAGTTCAGGTGAACGTTATGGGAGTTTTGGTGGCACAAGGGAGGGT
GATTCGTTCAGCAACAGTTACAAGGACAAAGAATCTGCTAAAACCTCTGCAGGTAGTAATGGCAGC
AAGAAATCTGGCAGCAAGACAAGAAAAGATGCGAAGCATGATAGAAGCTCCTCGAAGCCACCATCT
ACTGCAAAAAGCAATGAAGATGACTTCGATGACTTTGATCCCCGTGGATCTTCTTCAAATGATGCA
GCTAACAATGCGAAGACTAGCGAGGTCGATCTTTTTGGCCCAAACTTGATGGATGATTTCATGGAT
GAGCCTGCAGCCACTCCAGCAACAAAAGGTGTTGTAGAACCTCAGGTTGATCTATTTGGTGATGCA
GATTTCCAATCAGCAACCCCAAGTGCAGAAACTGCTGCGCATCAGGATGTCCAGGACAATGTTGAC
CTTTTTGCGGGAAATGCAACCTTTGCTTCAGCATTTCCATCACAGACGGGGTTTATTCCACCACCA
AGTTCCGGGACATCTTCTTCTGCCAATAGTTTTGTGTCCAAGAAGACAGTACCTGAACCATTTGAT
CCTTTCGGTGATATTCCTTTAAGCAGTTTTGGAGGATCTGACCCATTTGGTGACTTCAGTTCCAAT
GTTGGATCATCTACTGCACCGCCAGCTGTACACAATTCCACTGGAAATATCAGCACGCCGAGTCAG
AACTCTCAGGCAGCATCAGACTTTGGCGCCTTTGAATCTAACACCGGAGGCGCAGCTAAAGATCCC
TTTGATTTTCTTCCGGTGGCAATTTTGGCAAAACAAACGTAACACCTTTGGCAGCTCCCAAAACC
GACACGTCTGATTTCGGTGCATTCGTAGCAAACACTGCGGAACGTGCTAAGGACCCCTTTGATCTT
TCTTCTAGCATCAACAATGGAAGGACAGGCCAAACACCTCTGGCAGCTCCCAAGTCTAACACCAAG
AAAGAAAATCTCCAGGTCAAATCTAGCATATGGGCCGACTCTTTGAGCCGTGGATTGATTGATCTG
AACATAACCGGACCAAAGAAGGTGAACTTGGCCGACGTTGGGATCGTGGGCGGCCTCGGTGATGGG
TCAGATGACAAGGCTCATCAGCCCTCCTGGAACATGGGCGGCGGGGGATCTGGTCTAGGGATGTC
TGGAATCCCTCCATCTACACAAGGCGGCGGCATCGAGAGCTTGGCGAACTACAACAAGTACCAGTT
TGGCTTCAAATGAGCGTTCAGGCGAGAGCGTTTGTAGTATTCTGGTGCTCTTGTTGCCGGGCTGTT
AAATGCATATTGATTTCTTTTCTTTTGTTATATACATCTGTTCTGGTGATTTCATTATGTTACCTG
TAA

SEQ ID NO: 74, AAB68030.1| Af10-protein [Avena fatua]
MDFMKVFDQTVREIKREVNLKVLKVPELEQKVLDATSDEPWGPHGSALSDVAQATKKYSECQMVMG
VLWARLAERDSNWRHVYKALTIIEYLIANGSERAVDNILDHFSKISVLSSFEFVEPNGKDAGINVR
KKVETLVGIINDKDRIKAVRDKAASNRDKYVGLSSTGSSYRSSSATVGSNYSSGERYGSFGGTREG
DSFSNSYKDKESAKTSAGSNGSKKSGSKTRKDAKHDRSSSKPPSTAKSNEDDFDDFDPRGSSSNDA
ANNAKTSEVDLFGPNLMDDFMDEPAATPATKGVVEPQVDLFGDADFQSATPSAETAAHQDVQDNVD
LFAGNATFASAFPSQTGFIPPPSSGTSSSANSFVSKKTVPEPFDPFGDIPLSSFGGSDPFGDFSSN
VGSSTAPPAVHNSTGNISTPSQNSQAASDFGAFESNTGGAAKDPFDFSSGGNFGKTNVTPLAAPKT
DTSDFGAFVANTAERAKDPFDLSSSINNGRTGQTPLAAPKSNTKKENLQVKSSIWADSLSRGLIDL
NITGPKKVNLADVGIVGGLGDGSDDKAHQPSWNMGGGGIWSRDVWNPSIYTRRRHRELGELQQVPV
WLQMSVQARAFVVFWCSCCRAVKCILISFLLLYTSVLVISLCYL

SEQ ID NO: 75, (gi|62198322:c48408-48374, c48227-48176, c47975-47896, c47816-47738, c47569-47486, c47348-47203, c46817-46476, c45054-45013, c44885-44796, c44720-44500, c44229-44051, c43679-42584, c42478-42015) Medicago truncatula chromosome 7 clone mth2-7m13, complete sequence
ATGAAGAAGGTTTTTGGTCAAACTGTTAGGGACCTTAAAAGAGAAGTGAACAAGAAAGTGCTCAAA
GTTCCTGGCATTGAACAGAAGGTTCTTGATGCTACTAGCAATGAACCATGGGGTCCTCATGGAACA
CTGCTTGCAGACATTGCTCAGGCAACTAGAAACCCTCATGAATACCAGATGATCATGTCAGTAGTC
TGGAAACGAATTAACGACACTGGCAAGAATTGGCGGCATGTCTACAAGGCTTTGACAGTACTTGAG
TACTTGGTGGCCCATGGTTCTGAGAGAGTCATAGATGAGATCAAAGAACATTCTTATCAAATATCG
ACTTTGTCCGACTTTCAATATATTGATTCCAGTGGAAGAGATCAAGGAAACAATGTCAGGAAAAAA
TCTCAGAATCTCGTTGTCCTTGTGAATGATAAAGAAAGAATCGTAGAAGTTAGACAGAAGGCTGCT
GTTAATAGGGAAAAGTTTCGCAATAACACACCAGGAGGAATGTATAGACCTGGTTCACACTCAAGC
ATTGGAAGCTATGGTGATCGATATGAAGAAGATCGTTATGCGAACAGGGAGGAAGATAGAAATGGC
TATGGTTATGGAAGAGAAAGAGAAATGGGCTCTAGAGATGATGATCGGTACAATCGCGATGGGGAT
CGTTATGGTAGAGATTATGAGGAACGTTATGGTAGGGACGGTTACAGAGATGATGATAGGGGAAGA
AGTCGAAGTGTTGACTATAATTATGATGATACTAGGAGCAGGAATTCTGATAGAGATCGTGATTTC
GATGACGATGGCCAACACTCGTCTCGAGGTAGCAATGCTAAAGTTGAAGACCAATCACTGGAAGCA
AGACTTCAGCGGAAACTTTCTGAGCAAAATTCGGGTGCTCCTCCTAGTTATGAAGAGGCTGTTGGT
GAAGCTCAGAGCCCTGTGCCTGAAAGGGATGTTGAAACTTCGGCAGAATCTGCTCCAAGAGGCTCG
TCCCCTCATGCAAGTGATAATCCTAGCCCAGCCTCTGCTCCTACTGGATCTTCTCCTGTAAGCAAT
AATCCAACTGAAGTAACTGCTGCTGCCAGTACATCTGTTGCTGCTAGTACTGCTGCTTCTACCCAG
GAAACTGAGCCCACTGATGATTTCTTTGACCCACGTGGTCCTACATCAGCTGCTCCAACCACCTCT
AATTTTGGCGAAATAGATTTGCTCGGTTCTTTATCAGACTCATTCTCTTCAAACGCTCTGCCTCTT
GTGCCCGCTACATCAGGAATTTCAACCCCTGAAGCAAACACTGGTTCAACAGCTTCTTTTGCAGCA
CCATCCTCTGGGTCCAATAATTTCAATCAGTCTTTTGAAGATCCGTTTGGTGATTCACCATTCAAG
GCTGATACTTCTGTTGAAACTGCTCCATCTCAACACCATGCACCTCAGACTACTGAACCATCCCAA
TCAGATGGTTTTAATGCTGACATGTCTAACTTTGGGTTTGGGGACTCATTTTCTATTGTACCATAC
TCTGCATCTGCTCCCAGTGACACTCAACCTTTCTCTGCTAACTCCCAGTTTTGTCCCAAGATTCG
GAAACTGATATTCTAGCTGACATTCTTCCTCCTGCACCATTACCTGAGATTACATCACAGCAGAAC
AGTTCAGCTCCTTCTTTTGGCCAACCTTCACCTTCCTTTTCAACTTCATCTGGATCATTTTCCGAA
CCAACTGGTCAACTTACTCTTCATCAAGGTTTCTCAGCTGCAACCAATCAACCTGCACAAACCCTT
CCAACTGGTCAATTTTCGCAGCCAGGCTTTTCAGCTTCTAATTCATCTTTTTCAGCCTCTACCAGT
CCATATGCACAGCAACCTTTTCCTTCTCATTCTGGTCAACCTGGCATGCCTGGGTTTTCGTCATCT FIGURE 7 (continued)

```
ACTGGACATTCTATGCAGCCACCTTTTGCTTCTCAAGGCGGTCAATCTACTGCACAAACAAGCGGT
CATACCTACGGTGGATTGTACTCCCTGGATACATCTCTTACTCCAGGAGCTCCAAACATGTATTCT
CAATCACAAAATGGATATAACGGATCTATGAACAGTGGGAACTACTTGCCACAGGGATCCTCAACA
GGCTTTCCTTCACAAATGACTCCCCAAGCTCCAACAGCACAACCGGCACAAATCACAAACTTTCCC
CATCATGGAGGATCTACTGCTTCTCCCTCTCCAACTGATCAAGCATCACAGTTCAACAACCAGAGC
TTCTTTGGACAACAAGGGAATGCAGCTCCCTTTAGCTCATCATATACCCCTCAAGTGCCTGCTCCC
AATGCTTCGCCGTATGCTGTTTCAGCGGCACCAAATTCTTTAGTTTCTCAACCATCCAAAGATAAG
TTTGAAACAAAATCAACAGTTTGGGCAGACACATTAAGCAGGGGACTGGTTAATTTAAACATATCT
GGACCTAAAACTAATCCATTAGCAGATATTGGCATTGACTTCGAATCCATTAATAGGAAGGAAAAG
AGAATGGAGAAGCCCACTAACACACCTGTAACATCAACTGTAAATATGGGTAAAGCTATGGGATCA
GGTTCAGGCATAGGTCGTGCTGGCGCTGGTGCTCTTAGACCTAATCCAAATTCGATGATGGGTTCT
GGTATGGGCATGGGTATGGGAATGGGCAATGCTCCCGGTGGTATGGGTATGGGCAATGCTCCCGGT
GGTATGGGTATGGGAGGTTACGGAGGAGGCATGAATCCATCCATGGGTATGGGTATGGGTATGGGG
GGAATGGGCATGGGGCAAGGATACCAGATGCAACCTCCTAATGGAATGCCTCCTGGTTCCAACATG
CCAGGTAACTATAATAATAACATGATGCGTCCAGGTGGTTATGCTCAACAGCCATATGGTGGATAC
CGATGA
```

SEQ ID NO: 76, ABN08674.1| Epsin, N-terminal; ENTH/VHS [Medicago truncatula]
```
MKKVFGQTVRDLKREVNKKVLKVPGIEQKVLDATSNEPWGPHGTLLADIAQATRNPHEYQMIMSVV
WKRINDTGKNWRHVYKALTVLEYLVAHGSERVIDEIKEHSYQISTLSDFQYIDSSGRDQGNNVRKK
SQNLVVLVNDKERIVEVRQKAAVNREKFRNNTPGGMYRPGSHSSIGSYGDRYEEDRYANREEDRNG
YGYGREREMGSRDDDRYNRDGDRYGRDYEERYGRDGYRDDDRGRSRSVDYNYDDTRSRNSDRDRDF
DDDGQHSSRGSNAKVEDQSLEARLQRKLSEQNSGAPPSYEEAVGEAQSPVPERDVETSAESAPRGS
SPHASDNPSPASAPTGSSPVSNNPTEVTAAASTSVAASTAASTQETEPTDDFFDPRGPTSAAPTTS
NFGEIDLLGSLSDSFSSNALPLVPATSGISTPEANTGSTASFAAPSSGSNNFNQSFEDPFGDSPFK
ADTSVETAPSQHHAPQTTEPSQSDGFNADMSNFGFGDSFSIVPYSASAPSDTQPFSANSQFLSQDS
ETDILADILPPAPLPEITSQQNSSAPSFGQPSPSFSTSSGSFSEPTGQLTLHQGFSAATNQPAQTL
PTGQFSQPGFSASNSSFSASTSPYAQQPFPSHSGQPGMPGFSSSTGHSMQPPFASQGGQSTAQTSG
HTYGGLYSLDTSLTPGAPNMYSQSQNGYNGSMNSGNYLPQGSSTGFPSQMTPQAPTAQPAQITNFP
HHGGSTASPSPTDQASQFNNQSFFGQQGNAAPFSSSYTPQVPAPNASPYAVSAAPNSLVSQPSKDK
FETKSTVWADTLSRGLVNLNISGPKTNPLADIGIDFESINRKEKRMEKPTNTPVTSTVNMGKAMGS
GSGIGRAGAGALRPNPNSMMGSGMGMGMGMGNAPGGMGMGNAPGGMGMGGYGGGMNPSMGMGMGMG
GMGMGQGYQMQPPNGMPPGSNMPGNYNNNMMRPGGYAQQPYGGYR
```

SEQ ID NO: 77, gi|110739530:295-2982 Arabidopsis thaliana mRNA for hypothetical protein, complete cds, clone: RAFL22-03-K14
```
ATGAAGAAAGTCTTCGGACAAACTGTTAGAGACCTTAAGAGAGAGGTCAACAAGAAAGTGCTCAAA
GTTCCTGGAGTAGAACAGAAGGTTCTAGATGCTACTAGTAATGAGCCATGGGGTCCACATGGATCA
CTTCTTGCTGATCTTGCGCAAGCTTCCAGAAATTATCATGAATATCAGCTGATCATGGTGGTCATA
TGGAAACGCCTTAGCGACACCGGAAAAAACTGGCGGCATGTCTATAAGGCTTTGACAGTTTTGGAG
TACATGGTAGGCCATGGATCAGAACGTGTTATAGACGAGATTAGAGAACGTGCATATCAAATTTCG
ACATTGTCCGATTTTCAGTATATTGATTCCGGTGGTAGAGATCAAGGAAGCAATGTTAGGAAGAAA
TCACAGAGCCTGGTGGCTTTGGTGAATGACAAGGAAAGAATAGCTGAAGTCAGACAGAAGGCTGCT
GCTAATAGAGATAAGTATCGCAGCTCAGCACCAGGTGGGATGTATAAGCCTTCAGGCGGATATGGG
GATAAATATGATTACGGAAGCCGGGATGAAGAGCGAAGTAGTTATGGAAGAGAAAGAGAATATGGT
```

```
TACAGAGATGATGATAGAAATAGTCGTGATGGAGATCGTCATTCCAGGGACTCTGAAGACCGGTAT
GGGAGAGATGGTAATAGGGATGATGATTACAGGGGAAGGAGCAGAAGTGTTGATAACTATGGGTCA
CGAGGTAGGAGTTCGGAAAGAGAGCGGGAGGATGATGGCCATTCTTCATCACGGGGCAGTGGTGCT
CGAGCTGATGATAATTCTCAGGATGGGAGAGGGGGGCTCCAGAGGAAGTTTTCTGAACAAAATATT
GGCGCTCCACCCAATTATGAAGAAGCTGTCAGTGATTCACGCAGCCCTGTATATAGTGAAAGGGAT
GGTGGGGAGACCCCACAAGTTACCGCTCCAGGAGCTGCTTCTCCTCCTCCCCCACAAGTTGCTGCT
CCAGAGGCTGCTTCTCCTCCAACTGGAACCAACACAGCCAATACAACTGCTACTTTTGTTAATGAA
TCACCTTCTCAGAAAGTTGAGACTTTCGATGAATTTGATCCACGCAGTGCGTTTTCAGCTGGCCCT
CCAGCATATGCATCTACAGATGGTGTTACAGCTCCTCCAACTGTGACTTCTATGTCTGCCCCTACC
ACCTCAAACAGTGTTGAGATGGACTTGCTTGGTTCCCTTGCAGACGTATTTTCATCAAACGCATTG
GCCATTGTACCAGCTGATTCTATCTATGTTGAAACCAATGGACAAGCAAACGCTGGTCCAGCTCCA
TCGTTTTCTACATCTCAGCCATCAACTCAGTCATTTGATGACCCATTTGGTGACTCTCCTTTCAAG
GCCTTCACTTCTACTGACACCGACTCAACCCCACAGCAGAATTTTGGAGCTTCTTTCCAGCCACCA
CCTCCAGCCTTCACTTCAGAGGTCTCACATCCTGATACTGCTCATAACTTTGGCTTTGGGGACTCA
TTTTCCGCCGTTGCCAATCCTGATCCTGCTTCTCAGAATGTGCAACCTCCATCGAACTCACCAGGT
TTTCCTCAAGAGCAATTTGCTACATCTCAGAGTGGTATTGATATCCTCGCTGGCATTCTCCCACCA
TCTGGACCTCCAGTACAATCGGGTCCCTCAATACCAACATCTCAATTTCCTCCCAGTGGAAACAAC
ATGTACGAGGGATTTCATTCTCAGCCGCCGGTATCTACAGCTCCAAACCTGCCTGGACAAACTCCA
TTTGGACAAGCTGTTCAACCATATAACATGGTTCCTCATTCTCAAAATATGACTGGAGCCATGCCA
TTTAATAGTGGAGGCTTCATGCACCAGCCGGGCTCACAAACTCCTTACTCTACCCCAAGTGGACCA
GCTGGTCAGTTCATGGCACACCAAGGTCATGGAATGCCGCCATCCCATGGTCCACAACGAACTCAA
TCCGGACCTGTTACTCTGCAAGGGAACAACAATGTCATGGGAGACATGTTCTCGCAAGCTACGCCC
AACTCCTTGACGTCATCATCATCTCATCCAGATCTCACACCTTTAACAGGAGCAATTGAGATTGTT
CCTCCGCCTCAGAAAAAGTTTGAGCCAAAATCATCAGTCTGGGCAGACACGTTGAGCAGGGGGCTT
GTTAACTTTAACATATCTGGATCTAAAACAAATCCATTGGCAGACATAGGAGTTGACTTCGAGGCG
ATCAACAGGAGAGAGAAACGGCTGGAGAAACAAACAAACACACCAGCAACATCGACTATCAATATG
GGTAAAGCCATGGGATCAGGCACTGGCTTAGGGCGTTCTGGTGCAACTGCTATGAGACCTCCACCT
AATCCAATGACAGGCTCTGGCATGCCCATGGGCGGAGGAATGGGTGTTGGTAGCTACGGAGGTATG
AACCAGAACCAACCCATGGGTATGGGTATGGGGGCCGGAATGAACCAAAACCAACCGATGGGTATG
GGAATGGGACCCGGCATGAACATGAACATGAACATGGAGGATATGGCCAAGGCTATCCGATGCAA
CCACAAAACCCAGGGATGGTACCTAGCCCAAACATGCCTGGCAATAACTACAATCCGATGATGGGT
CAAGGTGGTTACAACCCTCAACAATCCTATGGTGGTGGATACCGGTAA
```

SEQ ID NO: 78, BAF01674.1| hypothetical protein [Arabidopsis thaliana]

```
MKKVFGQTVRDLKREVNKKVLKVPGVEQKVLDATSNEPWGPHGSLLADLAQASRNYHEYQLIMVVI
WKRLSDTGKNWRHVYKALTVLEYMVGHGSERVIDEIRERAYQISTLSDFQYIDSGGRDQGSNVRKK
SQSLVALVNDKERIAEVRQKAAANRDKYRSSAPGGMYKPSGGYGDKYDYGSRDEERSSYGREREYG
YRDDDRNSRDGDRHSRDSEDRYGRDGNRDDDYRGRSRSVDNYGSRGRSSEREREDDGHSSRGSGA
RADDNSQDGRGGLQRKFSEQNIGAPPNYEEAVSDSRSPVYSERDGGETPQVTAPGAASPPPPQVAA
PEAASPPTGTNTANTTATFVNESPSQKVETFDEFDPRSAFSAGPPAYASTDGVTAPPTVTSMSAPT
TSNSVEMDLLGSLADVFSSNALAIVPADSIYVETNGQANAGPAPSFSTSQPSTQSFDDPFGDSPFK
AFTSTDTDSTPQQNFGASFQPPPPAFTSEVSHPDTAHNFGFGDSFSAVANPDPASQNVQPPSNSPG
FPQEQFATSQSGIDILAGILPPSGPPVQSGPSIPTSQFPPSGNNMYEGFHSQPPVSTAPNLPGQTP
FGQAVQPYNMVPHSQNMTGAMPFNSGGFMHQPGSQTPYSTPSGPAGQFMAHQGHGMPPSHGPQRTQ
```

FIGURE 7 (continued)

SGPVTLQGNNNVMGDMFSQATPNSLTSSSSHPDLTPLTGAIEIVPPPQKKFEPKSSVWADTLSRGL
VNFNISGSKTNPLADIGVDFEAINRREKRLEKQTNTPATSTINMGKAMGSGTGLGRSGATAMRPPP
NPMTGSGMPMGGGMGVGSYGGMNQNQPMGMGMGAGMNQNQPMGMGMGPGMNMNMNMGGYGQGYPMQ
PQNPGMVPSPNMPGNNYNPMMGQGGYNPQQSYGGGYR

SEQ ID NO: 79, gi|145361717:256-2943 Arabidopsis thaliana epsin N-terminal homology (ENTH) domain-containing protein (AT2G43160) mRNA, complete cds

ATGAAGAAAGTCTTCGGACAAACTGTTAGAGACCTTAAGAGAGAGGTCAACAAGAAAGTGCTCAAA
GTTCCTGGAGTAGAACAGAAGGTTCTAGATGCTACTAGTAATGAGCCATGGGTCCACATGGATCA
CTTCTTGCTGATCTTGCGCAAGCTTCCAGAAATTATCATGAATATCAGCTGATCATGGTGGTCATA
TGGAAACGCCTTAGCGACACCGGAAAAAACTGGCGGCATGTCTATAAGGCTTTGACAGTTTTGGAG
TACATGGTAGGCCATGGATCAGAACGTGTTATAGACGAGATTAGAGAACGTGCATATCAAATTTCG
ACATTGTCCGATTTTCAGTATATTGATTCCGGTGGTAGAGATCAAGGAAGCAATGTTAGGAAGAAA
TCACAGAGCCTGGTGGCTTTGGTGAATGACAAGGAAAGAATAGCTGAAGTCAGACAGAAGGCTGCT
GCTAATAGAGATAAGTATCGCAGCTCAGCACCAGGTGGGATGTATAAGCCTTCAGGCGGATATGGG
GATAAATATGATTACGGAAGCCGGGATGAAGAGCGAAGTAGTTATGGAAGAGAAAGAGAATATGGT
TACAGAGATGATGATAGAAATAGTCGTGATGGAGATCGTCATTCCAGGGACTCTGAAGACCGGTAT
GGGAGAGATGGTAATAGGGATGATGATTACAGGGGAAGGAGCAGAAGTGTTGATAACTATGGGTCA
CGAGGTAGGAGTTCGGAAAGAGAGCGGGAGGATGATGGCCATTCTTCATCACGGGCAGTGGTGCT
CGAGCTGATGATAATTCTCAGGATGGGAGAGGGGGGCTCCAGAGGAAGTTTTCTGAACAAAATATT
GGCGCTCCACCCAGTTATGAAGAAGCTGTCAGTGATTCACGCAGCCCTGTATATAGTGAAAGGGAT
GGTGGGGAGACCCCACAAGTTACCGCTCCAGGAGCTGCTTCTCCTCCTCCCCACAAGTTGCTGCT
CCAGAGGCTGCTTCTCCTCCAACTGGAACCAACACAGCCAATACAACTGCTACTTTTGTTAATGAA
TCACCTTCTCAGAAAGTTGAGACTTTCGATGAATTTGATCCACGCAGTGCGTTTTCAGCTGGCCCT
CCAGCATATGCATCTACAGATGGTGTTACAGCTCCTCCAACTGTGACTTCTATGTCTGCCCCTACC
ACCTCAAACAGTGTTGAGATGGACTTGCTTGGTTCCCTTGCAGACGTATTTTCATCAAACGCATTG
GCCATTGTACCAGCTGATTCTATCTATGTTGAAACCAATGGACAAGCAAACGCTGGTCCAGCTCCA
TCGTTTTCTACATCTCAGCCATCAACTCAGTCATTTGATGACCCATTTGGTGACTCTCCTTTCAAG
GCCTTCACTTCTACTGACACCGACTCAACCCCACAGCAGAATTTTGGAGCTTCTTTCCAGCCACCA
CCTCCAGCCTTCACTTCAGAGGTCTCACATCCTGATACTGCTCATAACTTTGGCTTTGGGGACTCA
TTTTCCGCCGTTGCCAATCCTGATCCTGCTTCTCAGAATGTGCAACCTCCATCGAACTCACCAGGT
TTTCCTCAAGAGCAATTTGCTACATCTCAGAGTGGTATTGATATCCTCGCTGGCATTCTCCCACCA
TCTGGACCTCCAGTACAATCGGGTCCCTCAATACCAACATCTCAATTTCCTCCCAGTGGAAACAAC
ATGTACGAGGGATTTCATTCTCAGCCGCCGGTATCTACAGCTCCAAACCTGCCTGGACAAACTCCA
TTTGGACAAGCTGTTCAACCATATAACATGGTTCCTCATTCTCAAAATATGACTGGAGCCATGCCA
TTTAATAGTGGAGGCTTCATGCACCAGCCGGGCTCACAAACTCCTTACTCTACCCCAAGTGGACCA
GCTGGTCAGTTCATGGCACACCAAGGTCATGGAATGCCGCCATCCCATGGTCCACAACGAACTCAA
TCCGGACCTGTTACTCTGCAAGGGAACAACAATGTCATGGGAGACATGTTCTCGCAAGCTACGCCC
AACTCCTTGACGTCATCATCATCTCATCCAGATCTCACACCTTTAACAGGAGCAATTGAGATTGTT
CCTCCGCCTCAGAAAAGTTTGAGCCAAATCATCAGTCTGGGCAGACACGTTGAGCAGGGGCTT
GTTAACTTTAACATATCTGGATCTAAAACAAATCCATTGGCAGACATAGGAGTTGACTTCGAGGCG
ATCAACAGGAGAGAGAAACGGCTGGAGAAACAAACAAACACACCAGCAACATCGACTATCAATATG
GGTAAAGCCATGGGATCAGGCACTGGCTTAGGGCGTTCTGGTGCAACTGCTATGAGACCTCCACCT

```
AATCCAATGACAGGCTCTGGCATGCCCATGGGCGGAGGAATGGGTGTTGGTAGCTACGGAGGTATG
AACCAGAACCAACCCATGGGTATGGGTATGGGGGCCGGAATGAACCAAAACCAACCGATGGGTATG
GGAATGGGACCCGGCATGAACATGAACATGAACATGGGAGGATATGGCCAAGGCTATCCGATGCAA
CCACAAAACCCAGGGATGGTACCTAGCCCAAACATGCCTGGCAATAACTACAATCCGATGATGGGT
CAAGGTGGTTACAACCCTCAACAATCCTATGGTGGTGGATACCGGTAA
```

SEQ ID NO: 80, NP_850387.1| epsin N-terminal homology (ENTH) domain-containing protein [Arabidopsis thaliana]

```
MKKVFGQTVRDLKREVNKKVLKVPGVEQKVLDATSNEPWGPHGSLLADLAQASRNYHEYQLIMVVI
WKRLSDTGKNWRHVYKALTVLEYMVGHGSERVIDEIRERAYQISTLSDFQYIDSGGRDQGSNVRKK
SQSLVALVNDKERIAEVRQKAAANRDKYRSSAPGGMYKPSGGYGDKYDYGSRDEERSSYGREREYG
YRDDDRNSRDGDRHSRDSEDRYGRDGNRDDYRGRSRSVDNYGSRGRSSEREREDDGHSSSRGSGA
RADDNSQDGRGGLQRKFSEQNIGAPPSYEEAVSDSRSPVYSERDGGETPQVTAPGAASPPPPQVAA
PEAASPPTGTNTANTTATFVNESPSQKVETFDEFDPRSAFSAGPPAYASTDGVTAPPTVTSMSAPT
TSNSVEMDLLGSLADVFSSNALAIVPADSIYVETNGQANAGPAPSFSTSQPSTQSFDDPFGDSPFK
AFTSTDTDSTPQQNFGASFQPPPPAFTSEVSHPDTAHNFGFGDSFSAVANPDPASQNVQPPSNSPG
FPQEQFATSQSGIDILAGILPPSGPPVQSGPSIPTSQFPPSGNNMYEGFHSQPPVSTAPNLPGQTP
FGQAVQPYNMVPHSQNMTGAMPFNSGGFMHQPGSQTPYSTPSGPAGQFMAHQGHGMPPSHGPQRTQ
SGPVTLQGNNNVMGDMFSQATPNSLTSSSSHPDLTPLTGAIEIVPPPQKKFEPKSSVWADTLSRGL
VNFNISGSKTNPLADIGVDFEAINRREKRLEKQTNTPATSTINMGKAMGSGTGLGRSGATAMRPPP
NPMTGSGMPMGGGMGVGSYGGMNQNQPMGMGMGAGMNQNQPMGMGMGPGMNMNMNMGGYGQGYPMQ
PQNPGMVPSPNMPGNNYNPMMGQGGYNPQQSYGGGYR
```

SEQ ID NO: 81, gi|51970931:294-2234 Arabidopsis thaliana mRNA, complete cds, clone: RAFL24-10-I21

```
ATGAAGAAAGTCTTCGGACAAACTGTTAGAGACCTTAAGAGAGAGGTCAACAAGAAAGTGCTCAAA
GTTCCTGGAGTAGAACAGAAGGTTCTAGATGCTACTAGTAATGAGCCATGGGGTCCACATGGATCA
CTTCTTGCTGATCTTGCGCAAGCTTCCAGAAATTATCATGAATATCAGCTGATCATGGTGGTCATA
TGGAAACGCCTTAGCGACACCGGAAAAAACTGGCGGCATGTCTATAAGGCTTTGACAGTTTTGGAG
TACATGGTAGGCCATGGATCAGAACGTGTTATAGACGAGATTAGAGAACGTGCATATCAAATTTCG
ACATTGTCCGATTTTCAGTATATTGATTCCGGTGGTAGAGATCAAGGAAGCAATGTTAGGAAGAAA
TCACAGAGCCTGGTGGCTTTGGTGAATGACAAGGAAAGAATAGCTGAAGTCAGACAGAAGGCTGCT
GCTAATAGAGATAAGTATCGCAGCTCAGCACCAGGTGGGATGTATAAGCCTTCAGGCGGATATGGG
GATAAATATGATTACGGAAGCCGGGATGAAGAGCGAAGTAGTTATGGAAGAGAAAGAGAATATGGT
TACAGAGATGATGATAGAAATAGTCGTGATGGAGATCGTCATTCCAGGGACTCTGAAGACCGGTAT
GGGAGAGATGGTAATAGGGATGATGATTACAGGGGAAGGAGCAGAAGTGTTGATAACTATGGGTCA
CGAGGTAGGAGTTCGGAAAGAGAGCGGGAGGATGATGGCCATTCTTCATCACGGGCAGTGGTGCT
CGAGCTGATGATAATTCTCAGGATGGGAGAGGGGGCTCCAGAGGAAGTTTTCTGAACAAAATATT
GGCGCTCCACCCAGTTATGAAGAAGCTGTCAGTGATTCACGCAGCCCTGTATATAGTGAAAGGGAT
GGTGGGGAGACCCCACAAGTTACCGCTCCAGGAGCTGCTTCTCCTCCTCCCCACAAGTTGCTGCT
CCAGAGGCTGCTTCTCCTCCAACTGGAACCAACACAGCCAATACAACTGCTACTTTTGTTAATGAA
TCACCTTCTCAGAAAGTTGAGACTTTCGATGAATTTGATCCACGCAGTGCGTTTTCAGCTGGCCCT
CCAGCATATGCATCTACAGATGGTGTTACAGCTCCTCCAACTGTGACTTCTATGTCTGCCCCTACC
ACCTCAAACAGTGTTGAGATGGACTTGCTTGGTTCCCTTGCAGACGTATTTTCATCAAACGCATTG
GCCATTGTACCAGCTGATTCTATCTATGTTGAAACCAATGGACAAGCAAACGCTGGTCCAGCTCCA
```

TCGTTTTCTACATCTCAGCCATCAACTCAGTCATTTGATGACCCATTTGGTGACTCTCCTTTCAAG
GCCTTCACTTCTACTGACACCGACTCAACCCCACAGCAGAATTTTGGAGCTTCTTTCCAGCCACCA
CCTCCAGCCTTCACTTCAGAGGTCTCACATCCTGATACTGCTCATAACTTTGGCTTTGGGGACTCA
TTTTCCGCCGTTGCCAATCCTGATCCTGCTTCTCAGAATGTGCAACCTCCATCGAACTCACCAGGT
TTTCCTCAAGAGCAATTTGCTACATCTCAGAGTGGTATTGATATCCTCGCTGGCATTCTCCCACCA
TCTGGACCTCCAGTACAATCGGGTCCCTCAATACCAACATCTCAATTTCCTCCCAGTGGAAACAAC
ATGTACGAGGGGTTTCATTCTCAGCCGCCGGTATCTACAGCTCCAAACCTGCCTGGACAAACTCCA
TTTGGACAAGCTGTTCAACCATATAACATGGTTCCTCATTCTCAAAATATGACTGGAGCCATGCCA
TTTAATAGTGGAGGCTTCATGCACCAGCCGGGCTCACAAACTCCTTACTCTACCCCAAGTGGACCA
GCTGGTCAGTTCATGGCACTGGCTTAG

SEQ ID NO: 82, BAD44158.1| unnamed protein product [Arabidopsis thaliana]
MKKVFGQTVRDLKREVNKKVLKVPGVEQKVLDATSNEPWGPHGSLLADLAQASRNYHEYQLIMVVI
WKRLSDTGKNWRHVYKALTVLEYMVGHGSERVIDEIRERAYQISTLSDFQYIDSGGRDQGSNVRKK
SQSLVALVNDKERIAEVRQKAAANRDKYRSSAPGGMYKPSGGYGDKYDYGSRDEERSSYGREREYG
YRDDDRNSRDGDRHSRDSEDRYGRDGNRDDDYRGRSRSVDNYGSRGRSSEREREDDGHSSSRGSGA
RADDNSQDGRGGLQRKFSEQNIGAPPSYEEAVSDSRSPVYSERDGGETPQVTAPGAASPPPPQVAA
PEAASPPTGTNTANTTATFVNESPSQKVETFDEFDPRSAFSAGPPAYASTDGVTAPPTVTSMSAPT
TSNSVEMDLLGSLADVFSSNALAIVPADSIYVETNGQANAGPAPSFSTSQPSTQSFDDPFGDSPFK
AFTSTDTDSTPQQNFGASFQPPPPAFTSEVSHPDTAHNFGFGDSFSAVANPDPASQNVQPPSNSPG
FPQEQFATSQSGIDILAGILPPSGPPVQSGPSIPTSQFPPSGNNMYEGFHSQPPVSTAPNLPGQTP
FGQAVQPYNMVPHSQNMTGAMPFNSGGFMHQPGSQTPYSTPSGPAGQFMALA

SEQ ID NO: 83, gi|25090232:1-2688 Arabidopsis thaliana At2g43170/F14B2.11 mRNA, complete cds
ATGAAGAAAGTCTTCGGACAAACTGTTAGAGACCTTAAGAGAGAGGTCAACAAGAAAGTGCTCAAA
GTTCCTGGAGTAGAACAGAAGGTTCTAGATGCTACTAGTAATGAGCCATGGGGTCCACATGGATCA
CTTCTTGCTGATCTTGCGCAAGCTTCCAGAAATTATCATGAATATCAGCTGATCATGGTGGTCATA
TGGAAACGCCTTAGCGACACCGGAAAAAACTGGCGGCATGTCTATAAGGCTTTGACAGTTTTGGAG
TACATGGTAGGCCATGGATCAGAACGTGTTATAGACGAGATTAGAGAACGTGCATATCAAATTTCG
ACATTGTCCGATTTTCAGTATATTGATTCCGGTGGTAGAGATCAAGGAAGCAATGTTAGGAAGAAA
TCACAGAGCCTGGTGGCTTTGGTGAATGACAAGGAAAGAATAGCTGAAGTCAGACAGAAGGCTGCT
GCTAATAGAGATAAGTATCGCAGCTCAGCACCAGGTGGGATGTATAAGCCTTCAGGCGGATATGGG
GATAAATATGATTACGGAAGCCGGGATGAAGAGCGAAGTAGTTATGGAAGAGAAAGAGAATATGGT
TACAGAGATGATGATAGAAATAGTCGTGATGGAGATCATCATTCCAGGGACTCTGAAGACCGGTAT
GGGAGAGATGGTAATAGGGATGATGATTACAGGGGAAGGAGCAGAAGTGTTGATAACTATGGGTCA
CGAGGTAGGAGTTCGGAAAGAGAGCGGGAGGATGATGGCCATTCTTCATCACGGGGCAGTGGTGCT
CGAGCTGATGATAATTCTCAGGATGGGAGAGGGGGCTCCAGAGGAAGTTTTCTGAACAAAATATT
GGCGCTCCACCCAGTTATGAAGAAGCTGTCAGTGATTCACGCAGCCCTGTATATAGTGAAAGGGAT
GGTGGGGAGACCCCACAAGTTACCGCTCCAGGAGCTGCTTCTCCTCCTCCCCACAAGTTGCTGCT
CCAGAGGCTGCTTCTCCTCCAACTGGAACCAACACAGCCAATACAACTGCTACTTTTGTTAATGAA
TCACCTTCTCAGAAAGTTGAGACTTTCGATGAATTTGATCCACGCAGTGCGTTTTCAGCTGGCCCT
CCAGCATATGCATCTACAGATGGTGTTACAGCTCCTCCAACTGTGACTTCTATGTCTGCCCCTACC
ACCTCAAACAGTGTTGAGATGGACTTGCTTGGTTCCCTTGCAGACGTATTTTCATCAAACGCATTG FIGURE 7 (continued)

```
GCCATTGTACCAGCTGATTCTATCTATGTTGAAACCAATGGACAAGCAAACGCTGGTCCAGCTCCA
TCGTTTTCTACATCTCAGCCATCAACTCAGTCATTTGATGACCCATTTGGTGACTCTCCTTTCAAG
GCCTTCACTTCTACTGACACCGACTCAACCCCACAGCAGAATTTTGGAGCTTCTTTCCAGCCACCA
CCTCCAGCCTTCACTTCAGAGGTCTCACATCCTGATACTGCTCATAACTTTGGCTTTGGGGACTCA
TTTTCCGCCGTTGCCAATCCTGATCCTGCTTCTCAGAATGTGCAACCTCCATCGAACTCACCAGGT
TTTCCTCAAGAGCAATTTGCTACATCTCAGAGTGGTATTGATATCCTCGCTGGCATTCTCCCACCA
TCTGGACCTCCAGTACAATCGGGTCCCTCAATACCAACATCTCAATTTCCTCCCAGTGGAAACAAC
ATGTACGAGGGATTTCATTCTCAGCCGCCGGTATCTACAGCTCCAAACCTGCCTGGACAAACTCCA
TTTGGACAAGCTGTTCAACCATATAACATGGTTCCTCATTCTCAAAATATGACTGGAGCCATGCCA
TTTAATAGTGGAGGCTTCATGCACCAGCCGGGCTCACAAACTCCTTACTCTACCCCAAGTGGACCA
GCTGGTCAGTTCATGGCACACCAAGGTCATGGAATGCCGCCATCCCATGGTCCACAACGAACTCAA
TCCGGACCTGTTACTCTGCAAGGGAACAACAATGTCATGGGAGACATGTTCTCGCAAGCTACGCCC
AACTCCTTGACGTCATCATCATCTCATCCAGATCTCACACCTTTAACAGGAGCAATTGAGATTGTT
CCTCCGCCTCAGAAAAAGTTTGAGCCAAAATCATCAGTCTGGGCAGACACGTTGAGCAGGGGCTT
GTTAACTTTAACATATCTGGATCTAAAACAAATCCATTGGCAGACATAGGAGTTGACTTCGAGGCG
ATCAACAGGAGAGAGAAACGGCTGGAGAAACAAACAAACACACCAGCAACATCGACTATCAATATG
GGTAAAGCCATGGGATCAGGCACTGGCTTAGGGCGTTCTGGTGCAACTGCTATGAGACCTCCACCT
AATCCAATGACAGGCTCTGGCATGCCCATGGGCGGAGGAATGGGTGTTGGTAGCTACGGAGGTATG
AACCAGAACCAACCCATGGGTATGGGTATGGGGGCCGGAATGAACCAAAACCAACCGATGGGTATG
GGAATGGGACCCGGCATGAACATGAACATGAACATGGGAGGATATGGCCAAGACTATCCGATGCAA
CCACAAAACCCAGGGATGGTACCTAGCCCAAACATGCCTGGCAATAACTACAATCCGATGATGGGT
CAAGGTGGTTACAACCCTCAACAATCCTATGGTGGTGGATACCGGTAA
```

SEQ ID NO: 84, AAN72258.1| At2g43170/F14B2.11 [Arabidopsis thaliana]

```
MKKVFGQTVRDLKREVNKKVLKVPGVEQKVLDATSNEPWGPHGSLLADLAQASRNYHEYQLIMVVI
WKRLSDTGKNWRHVYKALTVLEYMVGHGSERVIDEIRERAYQISTLSDFQYIDSGGRDQGSNVRKK
SQSLVALVNDKERIAEVRQKAAANRDKYRSSAPGGMYKPSGGYGDKYDYGSRDEERSSYGREREYG
YRDDDRNSRDGDHHSRDSEDRYGRDGNRDDDYRGRSRSVDNYGSRGRSSEREREDDGHSSSRGSGA
RADDNSQDGRGGLQRKFSEQNIGAPPSYEEAVSDSRSPVYSERDGGETPQVTAPGAASPPPPQVAA
PEAASPPTGTNTANTTATFVNESPSQKVETFDEFDPRSAFSAGPPAYASTDGVTAPPTVTSMSAPT
TSNSVEMDLLGSLADVFSSNALAIVPADSIYVETNGQANAGPAPSFSTSQPSTQSFDDPFGDSPFK
AFTSTDTDSTPQQNFGASFQPPPPAFTSEVSHPDTAHNFGFGDSFSAVANPDPASQNVQPPSNSPG
FPQEQFATSQSGIDILAGILPPSGPPVQSGPSIPTSQFPPSGNNMYEGFHSQPPVSTAPNLPGQTP
FGQAVQPYNMVPHSQNMTGAMPFNSGGFMHQPGSQTPYSTPSGPAGQFMAHQGHGMPPSHGPQRTQ
SGPVTLQGNNNVMGDMFSQATPNSLTSSSSHPDLTPLTGAIEIVPPPQKKFEPKSSVWADTLSRGL
VNFNISGSKTNPLADIGVDFEAINRREKRLEKQTNTPATSTINMGKAMGSGTGLGRSGATAMRPPP
NPMTGSGMPMGGGMGVGSYGGMNQNQPMGMGMGAGMNQNQPMGMGMGPGMNMNMNMGGYGQDYPMQ
PQNPGMVPSPNMPGNNYNPMMGQGGYNPQQSYGGGYR
```

FIGURE 7 (continued)

SEQ ID NO: 85, (gi|47497338:c68268-68234, c68117-68066, c67917-67838, c67744-67666, c67538-67455, c67343-67198, c67102-66758, c66599-66558, c66470-66372, c66293-66109, c65899-65700, c65334-64368, c64284-63761) Oryza sativa (japonica cultivar-group) genomic DNA, chromosome 2, BAC clone:OJ1111_C07

ATGAAGAAAGTATTCGATCAAACAGTCCGGGACCTAAAAAGAGAGGTGAACAAGAAGGTCCTCAAG
GTGCCTGGTATAGAACAAAAGATTCTTGATGCCACAAGCAACGAGCCATGGGGCCCACATGGATCA
CTCTTGGCAGAAATCGCCCAAGCAACACAAAATTACCATGAGTACCAGATGGTCATGAATGTTGTG
TGGAAGAGGATCAATGACACTGGTAAAAATTGGCGGCATGTTTATAAGGGATTGATTGTCCTGGAT
TACTTGGTTGCTCATGGTACAGAGCGAGTTATTGATGACATAAGGGAACATTCTTATCAGATATCG
ACACTAGCTGATTTCCAGTATATCGATTCGAGTGGGAGAGATCAAGGTAGCAATGTACGGCGGAAA
TCCCAGAGCCTTGTTAGTTTAGTTAATGACAAAGAGAGGATACAGGAAGTTAGGCAGAAAGCACTT
GCTACCAGGGACAAATACCGGAGTGCATTCGCCACCAGTGGAACACACAGGAGCCCAGGTGGCTAT
GACAATGACCGCTATGAAGGAAGCTATGGCAGTAGGTATGATAACAGAAATGGCTACGGGGGAGAA
AGAGAGTATGGATATAGGGATGATGACAGATATGGTGTTGCTGGAACTACTCCCAATCGGGAAGGA
GATCGTTATTCTAGGGATTCTAATGAGCAGCGCTACAGCAGAGATAGAGAAGATGAGTACAAAGGA
AGTCATAGCAACCATGAATATGCAGAAGGATCAGGTCGCAGGAGCTATGGACGAGATAGGGATTCA
TATGGGGATGATGAAGCTTATTCATCCCGTGGCCGGCAAAGCAATGCTGACGGACCTACTCAGGAT
GAGAGGCCCATGGAGCGGAAGCCTTCTAACCAGCAGATTGCTTCACCACCGCCAAACTATGAAGAT
GTCACAAGAGATACACAGGATAATAATCATGATGGACGAAATGGAGGGACTGTGCCTGTGCCAGTT
GCTGCAGCAAAGGTGTCTTCACCTCCAAGAACAAGTGTACCCCCAGGTCAGGTGAATGGTGTACAT
GATAATACTGTGGAAGACGTACCTGCACCACCACCTACTCATCCTGAAGTTAATGGGTTTGACGAG
TTTGATCCTCGTGGATCAGTACCAGATACCTCACCTCCAGTGAACCCCTCACAAGCCGTGAATAGC
TTGGAAATGGATTTATTCGGACCAGATCCTATTAATTCGTTGGCTTTGGTATCTGTGCCTCAGCCA
ACTGCCAGCCCAAATGTTGAGCCATCAGCAAATCCAGGATTTGAGAGTAACAGTTTTATGGGCATG
CCACCGGCTTCTACTGGATTCAATGAGGCCTTTGATGCAACTAATCCTTTTGGGGATCCTACGCCT
TTCAAGGCTGTTCATGAAGAAACTCCTGCAGTTTCTCAGACAAATGCTGCACCTGCTGGTTCTTTC
CATGCTACTGAACCTGCTGCAGATGCAAATCCTTTCCAGCCTGCTTCAGCAGCAAGCTTTGGTTTT
GGAGACACTCTTGGCGACCTCTCTTTTGGATCGAATGCTGCACCCGGGCAGCAAGATATTTTTGTG
CCCACCTCATCACATTCAGAGGTACCACCTGCAAACCCATCTGTGCACCCTGAACAGGCAGTCCCA
TCTTATGTCTCCTCCCAGGCACCTCAGCCTGCAGCTGCTGGTCCACAAACTCATGCTGCTCCCGCT
TCATTTGCTTCTCAAGCACCTCCCACTTCATTTGCTTCTCAAGCACCTCAAGCAGGGGCACCCTAT
CCTCAGGCTGCCTCCACATTTCCTCATTCACAAGCATCTCATCCTGCAGCCACTAATCCATCTACA
ATCCCTCAGAATGTTGCCACACCATTTGCTCCTTTACAAATGCCTCAACCTGTACCATCAGGCCAA
TCAAACTATTTTATGCAACCAGTTCCAGGGACTGGCATTAATGGCATGTCTGGGGCTCCTTCACAG
AATGGAGCACCATCCTACATCCCTTCACAGGCTTCTCAATTTGCAGCTCCAACAAATCTACAGCCC
TCTCAGCCAACCTTCCCCCACAAACTGCCATGGCAGCTTCACAGGCAACATCAATTTCTCGAGGG
GCATCTCAGCCTCTTGCAGTGCCGAATTCAATGCCTTCTGGTGTGAACTTTCCATTACAATCAAGT
TCATCAGCTCCCCCTGAAACAATCCTTTCAGCCTTGCAAGTTAGTCAGTCTGAGCCAGTGAAGAAA
TTTGAGTCCAAATCTACAGTTTGGGCTGATACATTGAGCCGAGGTTTAGTCAATCTGGACATCTCT
GGACCAAAGGCTAATCCGCACGCTGATATTGGAGTTGACTTCGATTCAATCAATCGCAAGGAGAAA
AGGCAAGAAAAGAAAGTCTCTCAAGCTCCTGTGGTATCTACGATCACTATGGGCAAAGCCATGGGA

FIGURE 7 (continued)

```
ACTGGCTCCGGCATCGGTCGGGCAGGTGCGAGTGCCATGGCACCTCCAGCCAACCCAATGGGTGCA
AGCAGGGGCATTGGCATGGGTATGGGCGCTGCTGGTTCCGGTTACGGTGGTGGAATGGGAATGAAC
CGGCCAATGGGCATGGGAATGGGAATGAACCAACAAATGGGTATGGGAATGGGGATGAACCAACAG
GCCATGGGAATGGGGATGAACCAACAGGCCATGGGAATGGGGATGAACCAACAACCAATGGGAATG
AACATGGGCATGGGGATGAACCAGGGTATGGGAATGAACATGCGGCCTCCTATGGGAATGGGTCCA
GGTAGTGGATATAATCCAATGGGTACCGGATACGGAGGGCAGCAACCATATGGTGGGTACAGGTGA
```

SEQ ID NO: 86, BAD19387.1| putative epsin 2a [Oryza sativa (japonica cultivar-group)]
```
MKKVFDQTVRDLKREVNKKVLKVPGIEQKILDATSNEPWGPHGSLLAEIAQATQNYHEYQMVMNVV
WKRINDTGKNWRHVYKGLIVLDYLVAHGTERVIDDIREHSYQISTLADFQYIDSSGRDQGSNVRRK
SQSLVSLVNDKERIQEVRQKALATRDKYRSAFATSGTHRSPGGYDNDRYEGSYGSRYDNRNGYGGE
REYGYRDDDRYGVAGTTPNREGDRYSRDSNEQRYSRDREDEYKGSHSNHEYAEGSGRRSYGRDRDS
YGDDEAYSSRGRQSNADGPTQDERPMERKPSNQQIASPPPNYEDVTRDTQDNNHDGRNGGTVPVPV
AAAKVSSPPRTSVPPGQVNGVHDNTVEDVPAPPPTHPEVNGFDEFDPRGSVPDTSPPVNPSQAVNS
LEMDLFGPDPINSLALVSVPQPTASPNVEPSANPGFESNSFMGMPPASTGFNEAFDATNPFGDPTP
FKAVHEETPAVSQTNAAPAGSFHATEPAADANPFQPASAASFGFGDTLGDLSFGSNAAPGQQDIFV
PTSSHSEVPPANPSVHPEQAVPSYVSSQAPQPAAAGPQTHAAPASFASQAPPTSFASQAPQAGAPY
PQAASTFPHSQASHPAATNPSTIPQNVATPFAPLQMPQPVPSGQSNYFMQPVPGTGINGMSGAPSQ
NGAPSYIPSQASQFAAPTNLQPSQPTFPPQTAMAASQATSISRGASQPLAVPNSMPSGVNFPLQSS
SSAPPETILSALQVSQSEPVKKFESKSTVWADTLSRGLVNLDISGPKANPHADIGVDFDSINRKEK
RQEKKVSQAPVVSTITMGKAMGTGSGIGRAGASAMAPPANPMGASRGIGMGMGAAGSGYGGGMGMN
RPMGMGMGMNQQMGMGMGMNQQAMGMGMNQQAMGMGMNQQPMGMNMGMGMNQGMGMNMRPPMGMGP
GSGYNPMGTGYGGQQPYGGYR
```

SEQ ID NO: 87, (gi|7801664:40027-40061, 40171-40222, 40475-40554, 40634-40712, 40813-40896, 41012-41157, 41371-41682, 41869-41910, 42021-42122, 42215-42375, 42540-42775, 42882-44085, 44167-44705) Arabidopsis thaliana DNA chromosome 3, BAC clone F25L23
```
ATGAAGAAAGCATTTGGTCAAACTGTCAGAGACCTCAAGAGAGGGGTCAACAAGAAAGTGCTTAAA
GTACCTGGAATAGAACAGAAGGTTCTAGATGCTACCAGCAATGAGTCCTGGGGTCCGCATGGATCA
CTTCTTGCGGACATTGCACATGCTTCGAGAAATTACCATGAATACCAGATTACTATGGGAGTGTTA
TGGAAACGTCTTAGTGACTCTGGAAAAAATTGGCGGCATGTCTATAAGGCATTGACAGTCTTGGAG
TACATGGTAGGCCATGGATCAGAACGTGTCATAGAAGAGGTTAAAGAACATGCATATCAAATTACG
ACATTATCTGGTTTTCAGTATATTGATTCCAGCGGTAAAGATCAAGGTAGCAATGTCAGGAAGAAG
GCGCAGAGCCTTGTGGCTTTGGTTAATGACAAAGAAAGAATAACGGAGGTCAGAGAGAAGGCTGCT
GCTAACAGAGATAAGTATCATAACTCAATGCATAGGCCGTCAGGAGGATATGGGGACAAATATGAT
TACGAAGGCCGCTATGGAGACAGAGATGAAGGGCGAAGTAGTTATGGGAAAGAGAGAGAATATGGT
TACAGGGATGATGATAGAAATAGTCGTGATGGCGATCGTTATTCTAGAGACTCTGAAGACCGATAT
GGAAGAGATGGTAACACGGATGACGAATACCGTGGAAGGAGCAGAAGTGTTGATAATTACAATGGA
TCAAGAGGTAGGAGCTCGGACAGGGAACGGCCTATTGAGGATGATGGCCAATCCTCATCGCGGGAT
AGTGGTGCGCCAGCTGATGATCATTCTCAAGATGGGAGAGGGGGCTAGAGAGAAAGTTCTCTGAA
CAAAATATTGGTGCTGCTCCACCTAGTTATGAAGAAGCTGTGAGTGAATCACGGAGCCCTGTATAC
```

```
AGTGAAAGGGATGGTGGAGAGACCCCACAAGTTGCTCCTCCAGGAGCTGCTGCTTCTCCTCTTGCT
GAAAACATCAGCGTGGACAACAAAGCTGCTGATTTTGTTAATGAATCATCTCCTCAGCAAGTTGAG
GCTTTTGATGAATTTGATCCACGAGGTTCAGTTTCAGCATGTGCACCTACAGCTGGTGCTTCGGTT
CCTGCACCTATCCCACCAACAGTGGTTTCTACGCCTGCCCCGCCTGCCTCAATTAATGCAGAAATG
GATTTGCTTGGCTCTCTTTCAGATGTATTTTCACCAAATCCCTTGGCTATTGTAACATCTGATTCC
ACTTCTGTTGAAACCAATGGACAAGCAAACACTGGTTTAGCTCCATCGTTTTCTACTTCTCAGTCA
TCTACTCAGCCTTTTGATGATCCATTTGGTGACTCTCCTTTCAAAGCCATCACTTCTGCTGACACT
GAGACAAGCCAACATCAGAGTTTTGGAGTTCCTTTTCAGCCAACACCACCAACTTCAAATCCTAAC
AATGAACATAACTTTGGTTTTGGGAAGCATTTTCAGCTGTTACCGATTCTGAACCTGGCGTTCAA
AATATGCAAGCTCCACCGAACTTATCCGTCTTTCCTCAAGAGCAGTTTGATACATCGCAGAGCGAA
ATCGATATTCTTGCCGGCATTCTCCCACCATCTGGACCGCCAGTTTCTCTGTCTCCACAACCAGAT
TCCACTATGCCAACATCCCAATTTCATCCCAATGGTAACTCCTATGAAAGCTATCATCATCAAGCC
GCGCCTACAGATCTAAACATGCAAGGACAAACACCGTTTGGTCAAGCTTCACAACAATTTAACATG
GTTTCACATTCACAAAATCATCATGAAGGTATGCAATTCAACAATGGGGCTTCACGCAACAGCCA
GGCTATGCAGGTCCAGCAACCTCTCAACCTCCACAATATACTCCTGGTGTATCTTCACACCCACCA
AGTGAGAGTTTTCCTCACCAACCAGGTTCTGCCACCTCAGCAAGCTCGCAAACTCCTTACGCTACT
ACACCCAATGTATCAGCTGGGCAGTTTGATGGTGGGAGTTTCATGACACAGCAACCTTATGGTGTG
ACACAACAAGTTCATGTTGTCCCTTCCCATATACCACAGCGAACTCAATCTGGACCTGTTGCAGCG
TTTGGGAATAATAACATATCGTTGGAGATATGCACCAACCTGGTTCTACCCCCTCATCAAGCTCG
CAAACTCCTTACCCTACTACGCCCAATGCACCAAGTGGTCAGTTTGATGGTGGAAATTTTATGACA
CAACAACCTTATGGTGTGATACCGCAAGTTCATGGCGTCCCTTCCCATATACCACAGCGAACTCAA
TCTGGACCTGTTGCAGCGCACGGGAATAGTAACAATGTTGTTGGGGATATGTTTTCACCAGCTGGA
CTAAGTTCCTTGGAGACATCAGCATCGCAACCATCTCTCACACCTTTAACAGGAGCAATTGAAATT
GTTCCCCAAAATCAGAAGAAGTTTGAGCCAAAATCAACAATTTGGGCTGATACATTAAGTAGAGGG
CTAGTTAACTTCAACATTTCTGGACCGAAAACAAATCCATTGGCGGATATAGGAGTTGACTTCGAG
GCAATCAACAGGAAAGAGAAACGGCTAGAGAAACCAACTATCACACAACAACAAGTAACATCAACT
ATCAACATGGGGAAAGCCATGGGATCTGGTACTGGCTTAGGTCGCGCTGGTGCAGGTGCTATGAGA
CCTCCAACAAATTCAATGGTAGGCTCAAGCATGCCCACGGGCATGAATGTTGGTGGCTATGGAGGC
ATGAACCAACACCAACCCATAGGCATGAACCAAAACCATCCATGGGCATGAACCAAAACCTTTCC
ATGGGAATGAACCAGAACTATCCCATGGGAATGAACCAAAACTATCCAATGGGAATGGGCATGAAC
ATGAACATGGGCGGGTATGGACAAGGGTATCCGATGCAACCACAACAAGGAATGGGCATGGCTCCT
CCTGGTGCACCACAAGGCATGACCGGTGCCTATAATCCAATGATGGGTCAAGGCGGTTACAACCCT
CAGCAGCAGCAACCATATGGTGGAGGTTACCGGTAA
```

SEQ ID NO: 88, CAB91599.1| epsin-like protein [Arabidopsis thaliana]
MKKAFGQTVRDLKRGVNKKVLKVPGIEQKVLDATSNESWGPHGSLLADIAHASRNYHEYQITMGVL
WKRLSDSGKNWRHVYKALTVLEYMVGHGSERVIEEVKEHAYQITTLSGFQYIDSSGKDQGSNVRKK
AQSLVALVNDKERITEVREKAAANRDKYHNSMHRPSGGYGDKYDYEGRYGDRDEGRSSYGKEREYG
YRDDDRNSRDGDRYSRDSEDRYGRDGNTDDEYRGRSRSVDNYNGSRGRSSDRERPIEDDGQSSSRD
SGAPADDHSQDGRGGLERKFSEQNIGAAPPSYEEAVSESRSPVYSERDGGETPQVAPPGAAASPLA
ENISVDNKAADFVNESSPQQVEAFDEFDPRGSVSACAPTAGASVPAPIPPTVVSTPAPPASINAEM
DLLGSLSDVFSPNPLAIVTSDSTSVETNGQANTGLAPSFSTSQSSTQPFDDPFGDSPFKAITSADT FIGURE 7 (continued)

```
ETSQHQSFGVPFQPTPPTSNPNNEHNFGFGEAFSAVTDSEPGVQNMQAPPNLSVFPQEQFDTSQSE
IDILAGILPPSGPPVSLSPQPDSTMPTSQFHPNGNSYESYHHQAAPTDLNMQGQTPFGQASQQFNM
VSHSQNHHEGMQFNNGGFTQQPGYAGPATSQPPQYTPGVSSHPPSESFPHQPGSATSASSQTPYAT
TPNVSAGQFDGGSFMTQQPYGVTQQVHVVPSHIPQRTQSGPVAAFGNNNNIVGDMHQPGSTPSSSS
QTPYPTTPNAPSGQFDGGNFMTQQPYGVIPQVHGVPSHIPQRTQSGPVAAHGNSNNVVGDMFSPAG
LSSLETSASQPSLTPLTGAIEIVPQNQKKFEPKSTIWADTLSRGLVNFNISGPKTNPLADIGVDFE
AINRKEKRLEKPTITQQQVTSTINMGKAMGSGTGLGRAGAGAMRPPTNSMVGSSMPTGMNVGGYGG
MNQHQPIGMNQNHPMGMNQNLSMGMNQNYPMGMNQNYPMGMGMNMNMGGYGQGYPMQPQQGMGMAP
PGAPQGMTGAYNPMMGQGGYNPQQQQPYGGGYR
```

SEQ ID NO: 89, (gi|157353299:c1635596-1635562, c1635301-1635250, c1632104-1632025, c1631940-1631862, c1631546-1631463, c1631335-1631190, c1630346-1630150, c1630124-1630003, c1629988-1629969, c1629314-1629276, c1629143-1629048, c1628965-1628733, c1626082-1625904, c1625181-1624673, c1624381-1624170, c1624074-1623494) Vitis vinifera chromosome chr5 scaffold_67, whole genome shotgun sequence

```
ATGAAGAAGGCCATTGGTCAAACTGTTAGGGACCTTAAGAGAGAGGTGAATAAGAAAGTTCTTAAA
GTTCCAGGAATAGAACAGAAGGTTCTGGATGCTACTAGCAATGAGCCTTGGGGTCCTCATGGAACA
CATCTTGCAGATATTGCACAGGCTACCAGAAACTATCACGAGTACCAAATGATCATGTCAGTAATC
TGGAAGCGGATTAATGATACAGGAAAGAATTGGCGGCATGTCTACAAGGCTTTGACAGTTCTGGAA
TACTTGGTAGGCCATGGTTCTGAGCGTGTCATAGATGAGATTCGGGAGCATATATACCAAATATCA
ACTTTGTCAGACTTTCAATATATTGATTCAAGTGGGAGGGATCAGGGAAGCAATGTCAGAAAGAAA
TCTCAAAGTCTCGTGGCTCTGGTGAATGATAAAGAAAGGATACAGGAAGTTAGACAGAAGGCTGCT
GCCAACAGGGACAAGTTTCGCAACACAAACTCAGCAGGCGGTATGTATAGGCCCAGTTCATATTCT
AGTTCAGGAGGATATGGTGACCGTTATGATGATGATCGATATGAAGGCCGCTATGGGAGAGACGAA
GATCGAAATGGTTATGGGAGAGAAAGAGAATGGGGCAGCAGAGATGATGACCGGTATGGTAGAAAT
GGGGACTCATATGAGATTCTGATGAACGGTATGGTAGAGATGGCTATAAGGATGATGATTACAGGG
GAAGAAGTCGAAGCAATGAGGACTACCAGTATGGCTCTAGAAGTAGGAGTGCTGATAGAGATAGGG
ACCGAGAGCAACCATTCATCTAGAGGTGGTGCCCGAACTGATGAGCATCCTCAGTATGGAAGGCAG
CTTGAACGAAAATTTTCTGAACAAAATCTTGATGCTCCTCCTAGTTATGAAGAAGCTGTAGCTGAT
GCCCACAGTCCTGTTCATGATGAGAGGGATGGAGCAACCCCAGCAGCACCTGCCCCTAAAACATCT
TCTCCACCTGTAAGCACTAGTCCTAGCCAAGCAACAACTGCTGTTGGTCCTTCTACATCTCCTCCT
GCCAACAAGGAAGTTGATGCTTTTGATGAATTTGATCCGCGCGGTCCAGTCTCAGGTATGGAGAAT
CCTAGAGATTTGTCTGTTTGCCAGTATGTGCAGCTTGAGTCCAAACAATTTGCTTGCGCTTCTGTC
CCAGCTACATCAATTAGTCCGGAAATGGACTTACTTGGCTCTCTGTCAGAGTCATTTTCTTCAAAT
TCATTGGCTCTTGTGCCATCTGGACCTGCAACCACAACATCTGAGGCTGCTGTCCTTGGAAATGCT
GGGTCTGCACCCGCATCAGCAGCAATGCCATCTGGATCTGCTTCTTTTGAAGACCCATTTGGTGAC
TCCCCTTTTAGAGCTTTGCCTTCAGCAGAGAGTGTACCAGCTGAACCTCAGGATTCAGCTTCCACA
ACTTCCTTCCAGACCATGAATCAAACATCAGGACCACCCTTCCCAGTTACCCAAGGAGTGGACACG
GGTTCCAACTTTGACTTTGGGGACACTTTCCCTGGCATAACTTACACGCCATCCGGTGTCTCCACT
GCACAACCTCCTTCTGCAAGCCCACAATTTTCACCCCAAGAGCAATGGATTCCCCAGCAGAACAAT
```

```
GATATCCTAGCAGACATTCTACCACCTTCAGGATCTTCAGCTCCTGCCATTTCACAGGCTGCTTTC
CCAGCTCCAACTGGCCAGTCTGTGCAGCCAAACCCTAATGTTGTTGGGGGCTTTCTTGCACAGTCA
GGATCTGCAGATCATGCAGCTTCACAATTTTCTCCTCAGATTCCAACTGGACCAGCTGCACAATAT
AACAATGGGAACTTCCTTTCACATGGGCCAGTTACACATCCTAGCAATGATAACCTTGGTGGCTTA
TTTCCACAAGCTGGACCGCCTGGTTCAGTGATGTCACAGTCTACTCCCCCTGCTTCAACAGGTTCA
CTTGCTATAGTTCCTCAAGCATCCAAGGACAAGTTTGAAACGAAGTCAACGGTTTGGGCTGATACA
CTGAGCAGAGGATTAGTCAATTTGAATATATCTGGAGCTAAAATTAATCCATTGGCGGATATTGGA
ATTGATTTTGATGCCATTAATCGGAAAGAAAAGAGGATGGAGAAACCTAAGCCTGCTACCACAGCT
CCTGTATCTACTACTACAATGGGCAAGGCAATGGGATCTGGCTCTGGAATGGGTCGTGCTGGTGCA
GGTGCACTCAGGCCTCCACCAAATACTATGATGGGTTCAGGTATGGGAATGGGCATGGGCATGGGT
AGTGGCCCTGGTGCAGGCATGAGTATGGGTATGGGTGGTGGTCCTGGTTCAGGCATGGGTATGGGT
ATGGGTGGTGCCCCTGGAGTGGGCATGGGTATGGGTATGGGTGGTGCCCCTGCAGCAGCGGGTATG
GGTATGGGTATGGGGATGGAGGAGGCATGGGCATGGGAGGATATGGAGGCATGAATCAACCTATG
GGCATGGGTATGAATGTGGGCATGGGCATGAATATGGGAATGGGGCAAGGAGCCCAGATGCAACAA
CCAACTGGATTGCCTCCTGGGGGTTATAACCCCATGATGGGCTCAGGTGGTTATGCTCCTCAGCAA
CCATATGGTGGTGGCTACCGATGA
```

SEQ ID NO: 90, CAO45312.1| unnamed protein product [Vitis vinifera]
```
MKKAIGQTVRDLKREVNKKVLKVPGIEQKVLDATSNEPWGPHGTHLADIAQATRNYHEYQMIMSVI
WKRINDTGKNWRHVYKALTVLEYLVGHGSERVIDEIREHIYQISTLSDFQYIDSSGRDQGSNVRKK
SQSLVALVNDKERIQEVRQKAAANRDKFRNTNSAGGMYRPSSYSSSGGYGDRYDDDRYEGRYGRDE
DRNGYGREREWGSRDDDRYGRNGDSYEILMNGMVEMAIRMMITGEEVEAMRTTSMALEVGVLIEIG
TESNHSSRGGARTDEHPQYGRQLERKFSEQNLDAPPSYEEAVADAHSPVHDERDGATPAAPAPKTS
SPPVSTSPSQATTAVGPSTSPPANKEVDAFDEFDPRGPVSGMENPRDLSVCQYVQLESKQFACASV
PATSISPEMDLLGSLSESFSSNSLALVPSGPATTTSEAAVLGNAGSAPASAAMPSGSASFEDPFGD
SPFRALPSAESVPAEPQDSASTTSFQTMNQTSGPPFPVTQGVDTGSNFDFGDTFPGITYTPSGVST
AQPPSASPQFSPQEQWIPQQNNDILADILPPSGSSAPAISQAAFPAPTGQSVQPNPNVVGGFLAQS
GSADHAASQFSPQIPTGPAAQYNNGNFLSHGPVTHPSNDNLGGLFPQAGPPGSVMSQSTPPASTGS
LAIVPQASKDKFETKSTVWADTLSRGLVNLNISGAKINPLADIGIDFDAINRKEKRMEKPKPATTA
PVSTTTMGKAMGSGSGMGRAGAGALRPPPNTMMGSGMGMGMGMGSGPGAGMSMGMGGGPGSGMGMG
MGGAPGVGMGMGMGGAPAAAGMGMGMGMGGGMGMGGYGGMNQPMGMGMNVGMGMNMGMGQGAQMQQ
PTGLPPGGYNPMMGSGGYAPQQPYGGGYR
```

SEQ ID NO: 91, gi|16649016:245-3319 Arabidopsis thaliana epsin-like protein (At3g59290; F25L23_150) mRNA, complete cds
```
ATGAAGAAAGCATTTGGTCAAACTGTCAGAGACCTCAAGAGAGGGGTCAACAAGAAAGTGCTTAAA
GTACCTGGAATAGAACAGAAGGTTCTAGATGCTACCAGCAATGAGTCCTGGGGTCCGCATGGATCA
CTTCTTGCGGACATTGCACATGCTTCGAGAAATTACCATGAATACCAGATTACTATGGGAGTGTTA
TGGAAACGTCTTAGTGACTCTGGAAAAAATTGGCGGCATGTCTATAAGGCATTGACAGTCTTGGAG
TACATGGTAGCCATGGATCAGAACGTGTCATAGAAGAGGTTAAAGAACATGCATATCAAATTACG
ACATTATCTGGTTTTCAGTATATTGATTCCAGCGGTAAAGATCAAGGTAGCAATGTCAGGAAGAAG
GCGCAGAGCCTTGTGGCTTTGGTTAATGACAAAGAAAGAATAACGGAGGTCAGAGAGAAGGCTGCT
```

```
GCTAACAGAGATAAGTATCATAACTCAATGCATAGGCCGTCAGGAGGATATGGGGACAAATATGAT
TACGAAGGCCGCTATGGAGACAGAGATGAAGGGCGAAGTAGTTATGGGAAAGAGAGAGAATATGGT
TACAGGGATGATGATAGAAATAGTCGTGATGGCGATCGTTATTCTAGAGACTCTGAAGACCGATAT
GGAAGAGATGGTAACACGGATGACGAATACCGTGGAAGGAGCAGAAGTGTTGATAATTACAATGGA
TCAAGAGGTAGGAGCTCGGACAGGGAACGGCCTATTGAGGATGATGGCCAATCCTCATCGCGGGAT
AGTGGTGCGCCAGCTGATGATCATTCTCAAGATGGGAGAGGGGGGCTAGAGAGAAAGTTCTCTGAA
CAAAATATTGGTGCTGCTCCACCTAGTTATGAAGAAGCTGTGAGTGAATCACGGAGCCCTGTATAC
AGTGAAAGGGATGGTGGAGAGACCCCACAAGTTGCTCCTCCAGGAGCTGCTGCTTCTCCTCTTGCT
GAAAACATCAGCGTGGACAACAAAGCTGCTGATTTTGTTAATGAATCATCTCCTCAGCAAGTTGAG
GCTTTTGATGAATTTGATCCACGAGGTTCAGTTTCAGCAGCATGTGCACCTACAGCTGGTGCTTCG
GTTCCTGCACCTATCCCACCAACAGTGGTTTCTACGCCTGCCCCGCCTGCCTCAATTAATGCAGAA
ATGGATTTGCTTGGCTCTCTTTCAGATGTATTTTCACCAAATCCCTTGGCTATTGTAACATCTGAT
TCCACTTCTGTTGAAACCAATGGACAAGCAAACACTGGTTTAGCTCCATCGTTTTCTACTTCTCAG
TCATCTACTCAGCCTTTTGATGATCCATTTGGTGACTCTCCTTTCAAAGCCATCACTTCTGCTGAC
ACTGAGACAAGCCAACATCAGAGTTTTGGAGTTCCTTTTCAGCCAACACCACCAACTTCAAATCCT
AACAATGAACATAACTTTGGTTTTGGGGAAGCATTTTCAGCTGTTACCGATTCTGAACCTGGCGTT
CAAAATATGCAAGCTCCACCGAACTTATCCGTCTTTCCTCAAGAGCAGTTTGATACATCGCAGAGC
GAAATCGATATTCTTGCCGGCATTCTCCCACCATCTGGACCGCCAGTTTCTCTGTCTCCACAACCA
GATTCCACTATGCCAACATCCCAATTTCATCCCAATGGTAACTCCTATGAAAGCTATCATCATCAA
GCCGCGCCTACAGATCTAAACATGCAAGGACAAACACCGTTTGGTCAAGCTTCACAACAATTTAAC
ATGGTTTCACATTCACAAAATCATCATGAAGGTATGCAATTCAACAATGGGGCTTCACGCAACAG
CCAGGCTATGCAGGTCCAGCAACCTCTCAACCTCCACAATATACTCCTGGTGTATCTTCACACCCA
CCAAGTGAGAGTTTTCCTCACCAACCAGGTTCTGCCACCTCAGCAAGCTCGCAAACTCCTTACGCT
ACTACACCCAATGTATCAGCTGGGCAGTTTGATGGTGGGAGTTTCATGACACAGCAACCTTATGGT
GTGACACAACAAGTTCATGTTGTCCCTTCCCATATACCACAGCGAACTCAATCTGGACCTGTTGCA
GCGTTTGGGAATAATAACAATATCGTTGGAGATATGCACCAACCTGGTTCTACCCCCTCATCAAGC
TCGCAAACTCCTTACCCTACTACGCCCAATGCACCAAGTGGTCAGTTTGATGGTGGAAATTTTATG
ACACAACAACCTTATGGTGTGATACCGCAAGTTCATGGCGTCCCTTCCCATATACCACAGCGAACT
CAATCTGGACCTGTTGCAGCGCACGGGAATAGTAACAATGTTGTTGGGGATATGTTTTCACCAGCT
GGACTAAGTTCCTTGGAGACATCAGCATCGCAACCATCTCTCACACCTTTAACAGGAGCAATTGAA
ATTGTTCCCCAAAATCAGAAGAAGTTTGAGCCAAAATCAACAATTTGGGCTGATACATTAAGTAGA
GGGCTAGTTAACTTCAACATTTCTGGACCGAAAACAAATCCATTGGCGGATATAGGAGTTGACTTC
GAGGCAATCAACAGGAAAGAGAAACGGCTAGAGAAACCAACTATCACACAACAACAAGTAACATCA
ACTATCAACATGGGGAAAGCCATGGGATCTGGTACTGGCTTAGGTCGCGCTGGTGCAGGTGCTATG
AGACCTCCAACAAATTCAATGGTAGGCTCAAGCATGCCCACGGGCATGAATGTTGGTGGCTATGGA
GGCATGAACCAACACCAACCCATAGGCATGAACCAAAACCATCCCATGGGCATGAACCAAAACCTT
TCCATGGGAATGAACCAGAACTATCCCATGGGAATGAACCAAAACTATCCAATGGGAATGGGCATG
AACATGAACATGGGCGGGTATGGACAAGGGTATCCGATGCAACCACAACAAGGAATGGGCATGGCT
CCTCCTGGTGCACCACAAGGCATGACCGGTGCCTATAATCCAATGATGGGTCAAGGCGGTTACAAC
CCTCAGCAGCAGCAACCATATGGTGGAGGTTACCGGTAA
```

FIGURE 7 (continued)

SEQ ID NO: 92, AAL24360.1| epsin-like protein [Arabidopsis thaliana]
MKKAFGQTVRDLKRGVNKKVLKVPGIEQKVLDATSNESWGPHGSLLADIAHASRNYHEYQITMGVL
WKRLSDSGKNWRHVYKALTVLEYMVGHGSERVIEEVKEHAYQITTLSGFQYIDSSGKDQGSNVRKK
AQSLVALVNDKERITEVREKAAANRDKYHNSMHRPSGGYGDKYDYEGRYGDRDEGRSSYGKEREYG
YRDDDRNSRDGDRYSRDSEDRYGRDGNTDDEYRGRSRSVDNYNGSRGRSSDRERPIEDDGQSSSRD
SGAPADDHSQDGRGGLERKFSEQNIGAAPPSYEEAVSESRSPVYSERDGGETPQVAPPGAAASPLA
ENISVDNKAADFVNESSPQQVEAFDEFDPRGSVSAACAPTAGASVPAPIPPTVVSTPAPPASINAE
MDLLGSLSDVFSPNPLAIVTSDSTSVETNGQANTGLAPSFSTSQSSTQPFDDPFGDSPFKAITSAD
TETSQHQSFGVPFQPTPPTSNPNNEHNFGFGEAFSAVTDSEPGVQNMQAPPNLSVFPQEQFDTSQS
EIDILAGILPPSGPPVSLSPQPDSTMPTSQFHPNGNSYESYHHQAAPTDLNMQGQTPFGQASQQFN
MVSHSQNHHEGMQFNNGGFTQQPGYAGPATSQPPQYTPGVSSHPPSESFPHQPGSATSASSQTPYA
TTPNVSAGQFDGGSFMTQQPYGVTQQVHVVPSHIPQRTQSGPVAAFGNNNNIVGDMHQPGSTPSSS
SQTPYPTTPNAPSGQFDGGNFMTQQPYGVIPQVHGVPSHIPQRTQSGPVAAHGNSNNVVGDMFSPA
GLSSLETSASQPSLTPLTGAIEIVPQNQKKFEPKSTIWADTLSRGLVNFNISGPKTNPLADIGVDF
EAINRKEKRLEKPTITQQQVTSTINMGKAMGSGTGLGRAGAGAMRPPTNSMVGSSMPTGMNVGGYG
GMNQHQPIGMNQNHPMGMNQNLSMGMNQNYPMGMNQNYPMGMGMNMNMGGYGQGYPMQPQQGMGMA
PPGAPQGMTGAYNPMMGQGGYNPQQQQPYGGGYR

SEQ ID NO: 93, (gi|20197142:37947-37981, 38085-38136, 38376-38455, 38545-38623, 38723-38806, 38925-39070, 39338-39665) Arabidopsis thaliana chromosome 2 clone F14B2 map CIC10F02, complete sequence
ATGAAGAAAGTCTTCGGACAAACTGTTAGAGACCTTAAGAGAGAGGTCAACAAGAAAGTGCTCAAA
GTTCCTGGAGTAGAACAGAAGGTTCTAGATGCTACTAGTAATGAGCCATGGGGTCCACATGGATCA
CTTCTTGCTGATCTTGCGCAAGCTTCCAGAAATTATCATGAATATCAGCTGATCATGGTGGTCATA
TGGAAACGCCTTAGCGACACCGGAAAAAACTGGCGGCATGTCTATAAGGCTTTGACAGTTTTGGAG
TACATGGTAGGCCATGGATCAGAACGTGTTATAGACGAGATTAGAGAACGTGCATATCAAATTTCG
ACATTGTCCGATTTTCAGTATATTGATTCCGGTGGTAGAGATCAAGGAAGCAATGTTAGGAAGAAA
TCACAGAGCCTGGTGGCTTTGGTGAATGACAAGGAAAGAATAGCTGAAGTCAGACAGAAGGCTGCT
GCTAATAGAGATAAGTATCGCAGCTCAGCACCAGGTGGGATGTATAAGCCTTCAGGCGGATATGGG
GATAAATATGATTACGGAAGCCGGGATGAAGAGCGAAGTAGTTATGGAAGAGAAAGAGAATATGGT
TACAGAGATGATGATAGAAATAGTCGTGATGGAGATCGTCATTCCAGGGACTCTGAAGACCGGTAT
GGGAGAGATGGTAATAGGGATGATGATTACAGGGGAAGGAGCAGAAGTGTTGATAACTATGGGTCA
CGAGGTAGGAGTTCGGAAAGAGAGCGGGAGGATGATGGCCATTCTTCATCACGGTATGTTAAATTT
CAAGTCGCCTAA

SEQ ID NO: 94, AAC64305.1| putative clathrin binding protein (epsin) [Arabidopsis thaliana]
MKKVFGQTVRDLKREVNKKVLKVPGVEQKVLDATSNEPWGPHGSLLADLAQASRNYHEYQLIMVVI
WKRLSDTGKNWRHVYKALTVLEYMVGHGSERVIDEIRERAYQISTLSDFQYIDSGGRDQGSNVRKK
SQSLVALVNDKERIAEVRQKAAANRDKYRSSAPGGMYKPSGGYGDKYDYGSRDEERSSYGREREYG
YRDDDRNSRDGDRHSRDSEDRYGRDGNRDDDYRGRSRSVDNYGSRGRSSEREREDDGHSSSRYVKF
QVA

FIGURE 7 (continued)

SEQ ID NO: 95, (gi|147770399:c11995-11972, c9443-9364, c9279-9201, c8675-8530, c7681-7304, c6648-6610, c6477-6382, c6299-6139, c3430-3240, c2529-1882, c1418-807) Vitis vinifera contig VV78X019702.2, whole genome shotgun sequence ATGCCTGGAAGTGATGAGCGAATGGTTCTGGATGCTACTAGCAATGAGCCTTGGGGTCCTCATGGA
ACACATCTTGCAGATATTGCACAGGCTACCAGAAACTATCACGAGTACCAAATGATCATGTCAGTA
ATCTGGAAGCGGATTAATGATACAGGAAAGAATTGGCGGCATGTCTACAAGACTTTGTCAGACTTT
CAATATATTGATTCAAGTGGGAGGGATCAGGGAAGCAATGTCAGAAAGAAATCTCAAAGTCTCGTG
GCTCTGGTGAATGATAAAGAAAGGATACAGGAAGTTAGACAGAAGGCTGCTGCCAACAGGGACAAG
TTTCGCAACACAAACTCAGCAGGCGGTATGTATAGGCCCAGTTCATATTCTAGTTCAGGAGGATAT
GGTGACCGTTATGATGATGATCGATATGAAGGCCGCTATGGAAGAGACGAAGATCGAAATGGTTAT
GGGAGAGAAAGAGAATGGGGCAGCAGAGATGATGACCGGTATGGTAGAAATGGGGACTCATATGGT
CCTGAAGGGATCGCTATGGCAGAGATTCTGATGAACGGTATGGTAGAGATGGTTATAAGGATGAT
GATTACAGGGGAAGAAGTCGAAGCAATGAGGACTACCAGTATGGCTCTAGAAGTAGGAGTGCTGAT
AGAGATAGGGACCGTGCTTTTGATGAGGAGAGCAACCATTCATCTAGAGGTGGTGCCCGAACTGAT
GAGCATCCTCAGTATGGAAGGCAGCTTGAACGAAAATTTTCTGAACAAAATCTTGATGCTCCTCCT
AGTTATGAAGAAGCTGTAGCTGATGCCCACAGTCCTGTTCATGATGAGAGGGATGGAGCAACCCCA
GCAGCACCTGCCCCTAAAACATCTTCTCCACCTGTAAGCACTAGTCCTAGCCAAGCAACAACTGCT
GTTGGTCCTTCTACATCTCCTCCTGCCAACAAGGAAGTTGATGCTTTTGATGAATTTGATCCGCGC
GGTCCAGTTTCAGCTGTCCCAGCTACATCAATTAGTCCGGAAATGGACTTACTTGGCTCTCTGTCA
GAGTCATTTTCTTCAAATTCATTGGCTCTTGTGCCATCTGGACCTGCAACCACAACATCTGAGGCC
GCTGTCCTTGGAAATGCTGGGTCTGCACCCGCATCTGCAGCAAAGCCATCTGGATCTGCTGTTATG
AGCCAGTCTTTTGAAGACCCATTTGGTGACTCCCCTTTTAGAGCTTTGCCTTCAGCAGAGAGTGTA
CCAGCTCAACCTCAGGATTCAGCTTCCACAACTTCCTTCCAGACCATGAATCAAACATCAGGACCA
CCCTTCCCAGTTACCCAAGGAGTGGACACGGGTTCCAACTTTGACTTTGGGGACACTTTCCCTGGC
ATAACTTACACGCCATCCGGTGTCTCTACTGCACAACCTCCTTCTGCAAGCCCACAATTTTCACCC
CAAGAGCAATGGTTTCCCCAGCAGAACAATGATATCCTAGCAGATATTCTACCACCTTCAGGATCT
TCAGCTCCTGCCATTTCACAGGCTGCTTTCCCAGCTCCAACTGGCCAGTCTGTGCAGCCAAACCCT
AATGTTGTTGGGGGCTTTCTTGCACAGTCAGGATCTGCAGATCATGCAGCTTCACAATTTTCTCCT
CAGATTCCAACTGGACCAGCTGCACAATATAACAATGGGAACTTCCTTTCACAGTTGGGTTCTGCA
GCGCCTGTACCTTCACAGGCTCCTCTTCAARGTCCTGTACCTTCTCAGTCTCCTTTTCAAAGTCCT
GTACCTTCTCAGTCTCCTTTTCAAGCTCCTGTACCTTCTCAGTCTCCTTTTCAAGCTCCAGCTAAA
ATAGTGTCTTCATATGCAGCTAAAATTAATCCATTGGCGGATATTGGAATTGATTTTGATGCCATT
AATCGGAAAGAAAAGAGGATGGAGAAACCTAAGCCTGCTACCACAGCTCCTGTATCTACTACTACA
ATGGGCAAGGCAATGGGATCTGGTTCTGGAATGGGTCGTGCTGGTGCAGGTGCACTCAGGCCTCCA
CCAAATACTATGATGGGTTCAGGTATGGGAATGGGCATGGGCATGGGCATGGGTAGTGGCCCTGGT
GCAGGCATGAGTATGGGTATGGGTGGTGGTCCTGGTTCAGGCATGGGTATGGGTATGGGTGGTGCC
CCTGGAGTGGGCATGGGTATGGGTATGGGTGGTGCCCCTGCAGCAGCGGGTATGGGTATGGGTATG
GGTATGGGGATGGGAGGAGGCATGGGCATGGAGGATATGGAGGCATGAATCAACCTATGGGCATG
GGTATGAATGTGGGCATGAATATGGGAATGGGGCAAGGAGCCCAGATGCAACAACCAACTGGATTG
CCTCCTGGGGGTTATAACCCCATGATGGGCTCAGGTGGTTATGCTCCTCAGCAACCATATGGTGGT
GGCTACCGATGA

SEQ ID NO: 96, CAN66991.1| hypothetical protein [Vitis vinifera]
MPGSDERMVLDATSNEPWGPHGTHLADIAQATRNYHEYQMIMSVIWKRINDTGKNWRHVYKTLSDF
QYIDSSGRDQGSNVRKKSQSLVALVNDKERIQEVRQKAAANRDKFRNTNSAGGMYRPSSYSSSGGY
GDRYDDDRYEGRYGRDEDRNGYGREREWGSRDDDRYGRNGDSYGPEGDRYGRDSDERYGRDGYKDD
DYRGRSRSNEDYQYGSRSRSADRDRDRAFDEESNHSSRGGARTDEHPQYGRQLERKFSEQNLDAPP
SYEEAVADAHSPVHDERDGATPAAPAPKTSSPPVSTSPSQATTAVGPSTSPPANKEVDAFDEFDPR
GPVSAVPATSISPEMDLLGSLSESFSSNSLALVPSGPATTTSEAAVLGNAGSAPASAAKPSGSAVM
SQSFEDPFGDSPFRALPSAESVPAQPQDSASTTSFQTMNQTSGPPFPVTQGVDTGSNFDFGDTFPG
ITYTPSGVSTAQPPSASPQFSPQEQWFPQQNNDILADILPPSGSSAPAISQAAFPAPTGQSVQPNP
NVVGGFLAQSGSADHAASQFSPQIPTGPAAQYNNGNFLSQLGSAAPVPSQAPLQXPVPSQSPFQSP
VPSQSPFQAPVPSQSPFQAPAKIVSSYAAKINPLADIGIDFDAINRKEKRMEKPKPATTAPVSTTT
MGKAMGSGSGMGRAGAGALRPPPNTMMGSGMGMGMGMGMGSGPGAGMSMGMGGGPGSGMGMGMGGA
PGVGMGMGMGGAPAAAGMGMGMGMGMGGGMGMGGYGGMNQPMGMGMNVGMNMGMGQGAQMQQPTGL
PPGGYNPMMGSGGYAPQQPYGGGYR

SEQ ID NO: 97, gi|159486854:1-1632 Chlamydomonas reinhardtii predicted protein (CHLREDRAFT_179407) mRNA, complete cds
ATGTGGCACACTGTGGCCTTCACGAAGCTCAAAGTGCTGGAGGCGACCAACGAGGAGCCATGGGA
CCCCACGGGTCCGCGATGGGGGAGATTGCGCGTGCAGCGGAGGACCCAGAGAAATACAACCTCATC
ATGAACGTCATCAGCGAGCGCCTGCAGATGCGGGACGAGAACTGGCGCCTGTGCTACAAGGCGCTG
CTGCTGCTCGAGTACCTTGTTAAAAACGGGCCTTGGCGTGTGGTAGACGAGCTCAACCGCAGCGTG
TCCTCGCTGGAGCGACTGCGTGATGAGTTTGAGTACCGTGACCCGCAGGGCAAGGACCACGGTGTC
AACGTGCGGCAGAGGGCGGGTGAGCTGGCCTCACTCGTCAGCAACACCGACCGCGTTCGCCAGGAG
CGTGAAAAGGCTGCCAAAAACGCCAACAAGTATAAGGGCGTATCGTCGTCGGACATGCGCGGATTT
GGTGGCGGTAACCTGACATGGCTTCCTGCGCGCCCCAGCAGGCCTACCCCGGCACGGAGAGCGTG
CACATGCCTGCCGGCAGCAGCAGCAGCCACCACAGCCGCACCGGATCGGGCTCCAACGCCAACACC
TTTAACGCCTTCAACAACCCCACAGCCGCCGGCCACTCGGGCGGCGGCTTTGGTGGGCTGCGCGGC
ACTGGACCGGCGGCTGGGTCTGGGGTGGGGCCCGAGGAGGGCGAGGACCCATTCGAGGCCACCCGC
AAGCGGATAGAGCGGCTGAAGGCGGAGGGCGCGCTGCCGGAGCCGCCGCCGTCAGCGCTGCCGCCG
GGTCTGGCAGACGTGCCGGCCGCAGGCGCCAAGGCTCCCAAGAAGCTGTCCGAAATCAAAATCAAC
CCCGCGGTGGCCGCCACGTTCGCGTCCATGCCCATCGCGCCGCCGCCCAGCGGTGCAACCATAGGC
AAGCTGGCACCGCCTCCGGGCGCCGGTGGTGCTGCCAAGCCGCCGCTGCCGCTGCCCGCCGCGAGC
AACACCCTGGACCTGTTTGGGGAGCTGAGCGGCCCCACATCCTCGCAGCCCGCTCAGTCACAGCCC
GCGGCCAGCGCTGCTTCGGACTGGACGCTTTCGGCTCGGCGCCAGCTGTTGCGCCGGCGCCCGCT
GCGGCTCCGGCCGCGCCGGTGGATCCCTTTGCCGTGCTCGCCTCTGGACCCACCGCGGCCACAGCA
ACATCTGGTGGCAGCGCCTCGTTGGGCGGCTTTAAGCCCGCGGGTAGCGACGCACGCGAGTACCTCT
TCCAAGCCGGCGTGCCGCCGCCGCTGTCATTCGACGACTTCGCTGAGCTGCCCGCCGCGCCGCCT
GCAGCGGGGCAGACCCCTTCGCGGCACTGGCAAGCGGCGGCTCCGGCGGCTTCGCGCCCAGCG
GTACCAGCGCCAGCACCTGCGGCGGCCTTCGACCCGTTTGCGCCGGCGCCGTCGACCATGGCGACA
GCGCCTGCGACGAGCAGTGGGTTTGGCGACTTTATGAGCGGCAACCGGTCCTCATCGCACGCCAGC
TCCGGCGGCGCGGCTAGCTCGGGCGGCGCGACCATGGCAATGAACAAGGCGGGCGCGGCGCACGGG
GCTGCGGGGCAAAAGAGCAACGACCCGTTTGCAGGGCTAGGGTTCTAG

FIGURE 7 (continued)

SEQ ID NO: 98, XP_001701452.1| hypothetical protein CHLREDRAFT_179407 [Chlamydomonas reinhardtii]
MWHTVAFTKLKVLEATNEEPWGPHGSAMGEIARAAEDPEKYNLIMNVISERLQMRDENWRLCYKAL
LLLEYLVKNGPWRVVDELNRSVSSLERLRDEFEYRDPQGKDHGVNVRQRAGELASLVSNTDRVRQE
REKAAKNANKYKGVSSSDMRGFGGGNLTWLPARPQQAYPGTESVHMPAGSSSSHHSRTGSGSNANT
FNAFNNPTAAGHSGGGFGGLRGTGPAAGSGVGPEEGEDPFEATRKRIERLKAEGALPEPPPSALPP
GLADVPAAGAKAPKKLSEIKINPAVAATFASMPIAPPPSGATIGKLAPPPGAGGAAKPPLPLPAAS
NTLDLFGELSGPTSSQPAQSQPAASAASDWDAFGSAPAVAPAPAAAPAAPVDPFAVLASGPTAATA
TSGGSASLGGFKPAVATHASTSSKPGVPPPLSFDDFAELPAAPPAAGADPFAALASGGSAAASRPA
VPAPAPAAAFDPFAPAPSTMATAPATSSGFGDFMSGNRSSSHASSGGAASSGGATMAMNKAGAAHG
AAGQKSNDPFAGLGF

SEQ ID NO: 99, gi|145350954:1-594 Ostreococcus lucimarinus CCE9901 predicted protein (OSTLU_34819) mRNA, partial cds
ATGTTCAAAGCCGCGCTGACGACGATCAAGTCCGCGATCCCGGACGAGGTGGCGCAGGCGGCGAAG
AAGCGCGTCAATCAATGGAAAGGCATCGGCGACGACGAAGCGCTCGTCCGCGACGCGACGAACTCC
GAGCCCTGGGGCCCGCACGGGGAGCAGCTGCGCGCGATCGCGCGGCTCACGCGCGATGGGAAGTGG
GACGTCGTGCGCGAGGTGCTGGAGAAACGCTTGAAGAGCGCGCCGGAGGAGTGGCGACGCGCGTAC
AAGGCGCTCACCGTCGTCGAGTATCTCGTCGCGAACGGCGATCGAGCGATCGCGGAGGACGTCAGG
CGAAGGCGAATGATGGACGGCGCGCTGAGGTTCGAGTACAAGGACGCGCGAGGGAAGGATGAGGGG
GTGAACGTGCGACATCGAGCGGAAAAGATCAAGGCGTTGGTGGAAGATCCGAGATCGGTCGAGGAG
GCGAGGGAAAAGGCGGAGAGAAATCGCGGCAAGTACGCGGGGATGTCGAGCGAAGAAGCGCGGACG
CACGCGCGGAGAGGGTCGACGTCGAGCGCGGGTGGGTCGTTTTCGGGAGGGAGCGCGCTCGGCGGC

SEQ ID NO: 100, XP_001419857.1| predicted protein [Ostreococcus lucimarinus CCE9901]
MFKAALTTIKSAIPDEVAQAAKKRVNQWKGIGDDEALVRDATNSEPWGPHGEQLRAIARLTRDGKW
DVVREVLEKRLKSAPEEWRRAYKALTVVEYLVANGDRAIAEDVRRRRMMDGALRFEYKDARGKDEG
VNVRHRAEKIKALVEDPRSVEEAREKAERNRGKYAGMSSEEARTHARRGSTSSAGGSFSGGSALGG

SEQ ID NO: 101, TC288090 Oryza sativa (japonica cultivar-group) cDNA clone:J033044K11, full insert sequence
GGTCGTTATTCCGCGGCGCCATCTTCCTCTCTCCTCCGCCCTACGCGTCGCCCCGCCTCGCCTGGC
CTTCCCCGCGCATCCTGCACGGAGCCCTAGGAGGCTAGGAGAGGAAGAAGAACACGCGCGCGGGGG
GATAGTGGATAGCCGAAGCAACTCGATCGATCTGTGGCCGCGATCGTAGCTCTCTTCTTGGTCCGA
TCTCGTCTCTCCGGCATGGATTTCAGGAAGGTGCTCGACCAGACCGTCCGGGAGATAAGGAGGGA
GGTAAATCTTAAGGTGCTCAAGGTGCCGGAAATCGAGCAGAAGGTTCTTGATGCCACCAGCGACGA
GCCGTGGGGCCGCATGGTTCCGATTTGGCAGATATCGCCAGGGCCACCAAGAGCTACGGTGATAG
CGAAATTATAATGAATGTGTTATGGCAACGCCTGGGGAACACACTTGCGAATTGGCGTCACGTGTA
TAAGGCGTTGGCTGTGATCGAGTACCTTCTAGCTAATGGCACCGAACGTGCAGCTGATGGCATTGT
TGACAATAGCTCACGAATTGCAAAACTCACAAGATTTGAGTATTTGGAGCCTAATGGAAAAGATGT
TGGGCTCAATGTGCGTAAGAAGGCTGAAGCTGTTCTAGCAATTTTGGATGACAGGGAGAAGCTTCA
AGAGGTCAGAGAGAAGGCTGCCGTTACTAGAGACAAGTATTTTGGCTTATCATCAACTGGAATAAC
GCACAAATCGAGCGCAGCATCATTTGGCAGTGGCAGCTACTCATCTGGTAGCCACTATGGGAGCAC

FIGURE 7 (continued)

```
AGGAGGTTCAAGGGAGGTGGGATCATTCAAGGATATACACACAGGCACAGAATGGAAAAAGAACAA
GAAGGAAACAGTGTCAAACTACAGCAGCAATAGAGAAGGGTCTAAAGAAATTACTAACAGTGCAAC
CAGTTATAAGTCAAAAAAGAGTGAAAGGCATGGTAGAAGAAATCAAAATTCCTTAACATTACACTC
GAAGTTATCTGCAAATATTAGCACCACATCTGAAGCCCCAAGCTCAAAGAAAGGGGAAAATGAGGA
TGATGATGATTTCAACCCACGAGGATTTTCTACATCTACTGGAACAGGTACCACAAGATCTAATCA
CCTGGATCTCTTTGGTCCAAGCTTGATGGATGATCTTGTTGATTCTACTACATCCACTTCAACAGC
AACGCCAAATGTTAGCACACCTGCTGTGCCAGAGGTTGATTTATTTGCAGATGCAGCTTTCCAATC
AGCCAATGCTCCATTGGAGGCAGCAACGGTTTCTCACACTCAGGACAAAATTGATTTGTTTGCTGG
CAGACTGTCTTCTGCTGATTCATTTACTTCAGACACAGAGTTCTCAGTACGCGGTAGTCCTAACAA
GTCATCGGAGAAAAAATGTCTTCCGTTGTGCATCCTTCTACTTCTGCTTTTGATCCCTTCAAACA
ATCTTTTGCCACCTCATTTCCTTCAGATTCAGAGTTCTCAGTTCATGATCCGACAAGCAAATCTTC
TCAAGGAAAAACTCCCACACCAGAACATTCAAGTACAGCAGCTTTTGATCCTTTTGCTGCAATTCC
ACTGAAGAGTTTTGATGGATCCGAATCTTTTGGAACATTTTCTTCGAACACAGCCTCAAACATTAC
TGAACTGCCACGGGATTCTTCTGGGGGTCCCAAAAGTTCTGACCATGGTCCTTTGGAGGATGCCAA
TTTTGATGCCTTCACTTCACACTTGGGATCTTCCACAACAAGTGCAACTGAGTCCATGAATAAGCC
CATCAAAAAGCTTGGGCAGGACTCGATGTCAGCATCAAAATCAGTTGCAAAGAAAGAAACTTTTCA
GGTCAAATCTGGCATATGGGCTGACTCTTTGAGCCGAGGATTGATTGATTTGAATATAACTTCGTC
ACAAAAGAAGGTCGATCTCTCCGATGTTGGGATTGTCGGACCGCTGAGCGGCGGATCTGAGGATAA
AGGCCCGGGGGCGACGATGGGCACAGCACCAGGCCTTGTCAGTTCTAGTTTTCCATCAAAACAGA
AACATCCAGTGGAAGCGGTCATTTTCAGCACCAACAGTTTGGAAGCTTTAAGTGATTTTATCCAG
GATATGTCTTTTGTTCTATGGTTCTTGCAGAGTACTTCTTGGAGCATTCGTACAGCTCCATGCCTA
TAAGAGTAAACGTGTATATAGCTACCAAACTCTGTGCGATGATCAGGAGACGTGTTGCCAACTAAC
CAGCATCTTCTCTGCCCTTGAGGCATTAATATTTTTTACTTATGGCGAAATGGATATGTTTTGTG
TACATGAGTAAAGAACCAATGCCATGGTAGCAATTGTAAAAAGGGTTCATCAATTATGTGTGATAC
ACGCTCATATGAATTTTGAAAAATGAATAACGCAAAGCATTCTGGATGCTGGCAGTGCC
```

SEQ ID NO: 102, TC288090_11 [215 - 2098] Oryza sativa (japonica cultivar-group) cDNA clone:J033044K11, derived protein insert sequence
```
MDFRKVLDQTVREIRREVNLKVLKVPEIEQKVLDATSDEPWGPHGSDLADIARATKSYGDSEIIMN
VLWQRLGNTLANWRHVYKALAVIEYLLANGTERAADGIVDNSSRIAKLTRFEYLEPNGKDVGLNVR
KKAEAVLAILDDREKLQEVREKAAVTRDKYFGLSSTGITHKSSAASFGSGSYSSGSHYGSTGGSRE
VGSFKDIHTGTEWKKNKKETVSNYSSNREGSKEITNSATSYKSKKSERHGRRNQNSLTLHSKLSAN
ISTTSEAPSSKKGENEDDDDFNPRGFSTSTGTGTTRSNHLDLFGPSLMDDLVDSTTSTSTATPNVS
TPAVPEVDLFADAAFQSANAPLEAATVSHTQDKIDLFAGRLSSADSFTSDTEFSVRGSPNKSSEKK
MSSVVHPSTSAFDPFKQSFATSFPSDSEFSVHDPTSKSSQGKTPTPEHSSTAAFDPFAAIPLKSFD
GSESFGTFSSNTASNITELPRDSSGGPKSSDHGPLEDANFDAFTSHLGSSTTSATESMNKPIKKLG
QDSMSASKSVAKKETFQVKSGIWADSLSRGLIDLNITSSQKKVDLSDVGIVGPLSGGSEDKGPGAT
MGTAPGLVSSSFPSKTETSSGSGHFQHQQFGSFK
```

FIGURE 7 (continued)

SEQ ID NO: 103, EAZ13473.1| hypothetical protein OsJ_003298 [Oryza sativa (japonica cultivar-group)], putative splice variant of SEQ ID NO: 102
MDFRKVLDQTVREIRREVNLKVLKVPEIEQKVLDATSDEPWGPHGSDLADIARATKSYGDSEIIMN
VLWQRLGNTLANWRHVYKALAVIEYLLANGTERAADGIVDNSSRIAKLTRFEYLEPNGKDVGLNVR
KKAEAVLAILDDREKLQEVREKAAVTRDKYFGLSSTGITHKSSAASFGSGSYSSGSHYGSTGGSRE
VGSFKDIHTGTEWKKNKKETVSNYSSNREGSKEITNSATSYKSKKSERHGRSTTSEAPSSKKGENE
DDDDFNPRGFSTSTTPNVSTPAVPEVDLFADAAFQSANAPLEAATVSHTQDKIDLFAGRLSSADSF
TSDTEFSVRGSPNKSSEKKMSSVVHPSTSAFDPFKQSFATSFPSDSEFSVHDPTSKSSQGKTPTPE
HSSTAAFDPFAAIPLKSFDGSESFGTFSSNTASNITELPRDSSGPKSSDHGPLEDANFDAFTSHL
GSSTTSATESMNKPIKKLGQDSMSASKSVAKKETFQVKSGIWADSLSRGLIDLNITSSQKKVDLSD
VGIVGPLSGGSEDKGPGATMGTAPGLVSSSFPSKTETSSGSEYFLEHSYSSMPIRVNVYIATKLCA
MIRRRVAN SEQ ID NO: 104, EAY75756.1| hypothetical protein OsI_003603 [Oryza sativa (indica cultivar-group)]
MDFRKVLDQTVREIRREVNLKVLKVPEIEQKVLDATSDEPWGPHGSDLADIARATKSYGDSEIIMN
VLWQRLGNTLANWRHVYKALAVIEYLLANGTERAADGIVENSSRIAKLTRFEYLEPNGKDVGLNVR
KKAEAVLAILDDREKLQEVREKAAVTRDKYFGLSSTGITHKSSAASFGSGSYSSGSHYGSTGGSRE
VGSFKDIHTGTEWKKNKKETVSNYSSNREGSKEITNSATSYKSKKSERHGRSLMDDLVDSTTSTST
ATPNVSTPAVPEVDLFADAAFQSANAPLEAATVSHTQDKIDLFAGRLSSADSFTSDTEFSVRGSPN
KSSEKKMSSVVHPSTSAFDPFKQSFATSFPSDAEFSVHDPTSKSSQGKTPTPEHSSTAAFDPFAAI
PLKSFDGSESFGTFSSNTASNITELQRDSSGGPKSSDHGPLEDANFDAFTSHLGSSTTSATESMNK
PIKKLGQDSMSASKSVAKKETFQVKSGIWADSLSRGLIDLNITSSQKKVDLSDVGIVGPLSGGSED
KGPWYMGATMGTAPGLVSSSFPSKTETSSGSAHFQHHSLEALSDFYPGYVFCSMVLAEYFLEHSYS
SMPIRVNVYIATKLSAMIRRRVAN SEQ ID NO: 105, TC286634 Oryza sativa (japonica cultivar-group) cDNA clone:001-022-H05, full insert sequence
GGGCCATCGCCCACCGGCCCACGAGCACCATCTCTCCTCTCTGCTCCGCGAGTGGCCTTTTGCCCA
CCTAAGCCGCCTCCCCATCCTCTGCTTGCTCCGGCGGGCGGCGAGCGCCCCGCCGGACCGACGACG
ACCTCGCCGTCGAGCTGGTGGCCGCTCAACCTCTAGCGCTCGCAGGGATCCCGGGAAGCCTCCCTC
GGCCGCGTCACCACCGGCATCTGGTGCTTTCCGCTCCCACCACAGTGTGCTGCTCTCGTCAGTTGC
CACCGCCCGACTCGGCGCTCCGGAGCCCAGATCTTGGTTCCGGAGGATCCTCTCCGGCGATGGATT
TCGTGAAGGTTTTCGATCAGGCCGTGCGGGAGATAAAGAGGGAGGTCAATTTGAAGGTGCTCAAGG
TTCCAGAGCTCGAACAGAAGGTACTTGATGCAACAAGCGATGAACCTTGGGGCCCTCATGGTACTA
CTCTTTCAGAGCTATCACATGCCACCAAGAAGTTCGCTGAATGTCAGATGGTAATGAGTGTCCTCT
GGACTAGGCTGTCTGAGCGAGGCTCGAAATGGCGTCACGTGTATAAGGCTTTGACAATTATTGAGT
ACTTAATAGCCAATGGTTCTGAGCGGGCAGTTGATGACATTCTTGATCACTATTCAAAGATCTCGG
TTCTTTCAAGTTTTGAATATGTGGAACCTAATGAAAAGATGCTGGAATAAATGTGAGAAAGAAAG
TCGAAACTATATTGGGACTCATAAATGACAAGGAGAAAATAAAGTCTGTAAGAGAGAAAGCCGCCA
GTAATCGTGACAAGTATGTTGGGCTATCATCGACAGGGATAACATATAAGTCAAGCTCTGCTTCAT
TTGGTAGCAACTATAGTTCTGGTGAACGTTATGGGAGTTTTAGTGGTACAAGGGAAGGTGATTCAT
ACGGTGACAGTTATAGGGATAAAGAACCTGTTAAATCCTCTCCAAGTTATACTGGCAGCCAGAAAT

```
CTGGCAGCAGGATAAAAAAGGATGTGAATAGAAGGAATGAGGATTCACCGAGCTCCTTGAAGTCTA
ATGCAAAAGGCAATGAGGACGATTTTGATGATTTTGATCCTCGTGGATCTTCTTCAAATGGTGCAG
CTAATACAAACACCAGTGGCGTGGATCTTTTTGCCCCAAACTTATTGGATGATTTCATCGATGTGC
CTGCAGCAGCAACTCATGAAACAAACGACTCTGCAGACGCTCAGGTTGATCTGTTTGCTGATGCAG
ATTTCCAATCAGCAATACCAAGTACAGAAACAGCTGCGGGTTCAGATGTCCAGGGCAATGTAGACC
TTTTTGCGGAACAGCCAGCCTTCACAGCAGCCTTTCCACCACAGACAGGGTTTATTCCACCACCAA
GTTCTGGGACATCTGAAGCAAATACTTCCACGTCTAAGAACACAACTCCTGAACCTTTTGATCCTT
TTGGTGCTATTCCTATAAACAGCTTTGATGGATCTGATCCATTTGGTGCCTTCAACTCCGATGTTG
GATCATCTAGTATACCACCACCCACGCAGAGTTCTGTTGGAAATATCAGCACACCAAGTCAGAACC
CTCAAGCAGCATCTGACTTTGGTGGCTTTGTCGAGCACTGTAGAAACAGCAGCTAAGGACCCCT
TTGATTTTCAAGTAGCAATCTTGGGAAAACACCTTTGGCAGATCCAAAGGCTGATGCATCCGATT
TTGGTGCCTTTGTATCGCACAGTGAGGAAGTAGCCAAGGATCCTTTTGATCTTTCTTTGAGTACCA
GCTCTGGAAGGACAAACCAAGCACCTCTGGCGGCTCCCAAGTCAGATACCAAGAAAGAAAATTTTC
AGGTCAAGTCTGGCATATGGGCTGACTCATTGAGCCGTGGACTGATTGATCTGAACATAACTGGAC
CAAAGAAGGTGAACTTAGCCGACGTTGGGATTGTCGGTGGCCTCGATGACGGGTCTGATGATAAAG
CTCTGCCCTCATGGACCATGGGTGCAGGAGGTTCCAGCCTAGGAATGTCCGGAATTCCTTCATCTA
CACAAAGTGGTGGCATTGAGAGCTTAGCTAACTACAACAAGTACCAGTTTGGCTTTAAATGAGCTT
TCATGTGAGGCTTTCTAGTATATGCCGGTTATTGTCGGAATGTCGGCTTGTGCCTTATTTATTTTT
TGTTGATTCTATTCTCCCCTCTTTTGATGCTTACATTCCTTTACAATCGCCTCCAAGGATCGTGAT
CTTGGTTCGTCTTGTCGCGCTTGTATTGTATTTATTGGATTTGCGGATGAGAGACTCCTACCTATA
TCACACCCTGATTCAATTTAACTGTACTGTTATTTCACAATCGTGTTAATCCTATGGCTCACCTCT
ATATTGCGATTT
```

SEQ ID NO: 106, derived proteins sequence TC286634_10 [324 - 2105] Oryza sativa (japonica cultivar-group)
MDFVKVFDQAVREIKREVNLKVLKVPELEQKVLDATSDEPWGPHGTTLSELSHATKKFAECQMVMS
VLWTRLSERGSKWRHVYKALTIIEYLIANGSERAVDDILDHYSKISVLSSFEYVEPNGKDAGINVR
KKVETILGLINDKEKIKSVREKAASNRDKYVGLSSTGITYKSSSASFGSNYSSGERYGSFSGTREG
DSYGDSYRDKEPVKSSPSYTGSQKSGSRIKKDVNRRNEDSPSSLKSNAKGNEDDFDDFDPRGSSSN
GAANTNTSGVDLFAPNLLDDFIDVPAAATHETNDSADAQVDLFADADFQSAIPSTETAAGSDVQGN
VDLFAEQPAFTAAFPPQTGFIPPPSSGTSEANTSTSKNTTPEPFDPFGAIPINSFDGSDPFGAFNS
DVGSSSIPPPTQSSVGNISTPSQNPQAASDFGGFVSSTVETAAKDPFDFSSSNLGKTPLADPKADA
SDFGAFVSHSEEVAKDPFDLSLSTSSGRTNQAPLAAPKSDTKKENFQVKSGIWADSLSRGLIDLNI
TGPKKVNLADVGIVGGLDDGSDDKALPSWTMGAGGSSLGMSGIPSSTQSGGIESLANYNKYQFGFK

SEQ ID NO: 107, EAY95411.1| hypothetical protein OsI_016644 [Oryza sativa (indica cultivar-group)], variant of SEQ ID NO: 106
MDFVKVFDQAVREIKREVNLKVLKVPELEQKVLDATSDEPWGPHGTTLSELSHATKKFTGALYYEF
YIGHYANTNGQSEQQTLALTIIEYLIANGSERAVDDILDHYSKISVLSSFEYVEPNGKDAGINVRK
KVETILGLINDKEKIKSVREKAASNRDKYVGLSSTGITYKSSSASFGSNYSSGERYGSFSGTREGD
SYGDSYRDKEPVKSSPSYTGSQKSGSRIKKDVNRRNEDSPSSLKSNAKGNEDDFDDFDPRGSSSNG
AANTNTSGVDLFAPNLLDDFIDVPAAATHETNDSADAQVDLFADADFQSAIPSTETAAGSDVQGNV
DLFAEQPAFTAAFPPQTGFIPPPSSGTSEANTSTSKNTTPEPFDPFGAIPINSFDGSDPFGAFNSD
VGSSSIPPPTQSSVGNISTPSQNPQAASDFGGFVSSTVETAAKDPFDFSSSNLGKTPLADPKADAS
DFGAFVSHSEEVAKDPFDLSLSTSSGRTNQAPLAAPKSDTKKENFQVKSGIWADSLSRGLIDLNIT
GPKKVNLADVGIVGGLDDGSDDKALPSWTMGAGGSSLGMSGIPSSTQSGGIESLANYNKYQFGFK

FIGURE 7 (continued)

SEQ ID NO: 108, TC284943 RF|XP_507032.1|51964494|XM_507032 OJ1111_C07.17-1 gene product {Oryza sativa (japonica cultivar-group)} (exp=-1; wgp=0; cg=0), complete

```
GTCAGGGAAGAAGGGAGGACGCGACGCGACACGAGCGCGAGAGGAAAGCGGAGGAGATCGAGGAGA
AACTCCATTTCCCCCCCCCTCGCCTTCTCCGATTTCCCTCGCGTGGAATCCCCTTGGACTCCTCCC
CCTCCCGCCGCCGCGCGAGCCGGGCACGGCGAGCGGCGCCGCCCTGCCCCCGCCGATCTGCTCTGC
CTTCTCCTCAGGGGCTTGCACCGAGGAGGAGGAGGAGGAGAGAGCTGAGCAGAACAAGCTAGATTC
TCAAGGAAGGGCGCCATGAAGAAAGTATTCGATCAAACAGTCCGGGACCTAAAAAGAGAGGTGAAC
AAGAAGGTCCTCAAGGTGCCTGGTATAGAACAAAAGATTCTTGATGCCACAAGCAACGAGCCATGG
GGCCCACATGGATCACTCTTGGCAGAAATCGCCCAAGCAACACAAAATTACCATGAGTACCAGATG
GTCATGAATGTTGTGTGGAAGAGGATCAATGACACTGGTAAAAATTGGCGGCATGTTTATAAGGGA
TTGATTGTCCTGGATTACTTGGTTGCTCATGGTACAGAGCGAGTTATTGATGACATAAGGGAACAT
TCTTATCAGATATCGACACTAGCTGATTTCCAGTATATCGATTCGAGTGGGAGAGATCAAGGTAGC
AATGTACGGCGGAAATCCCAGAGCCTTGTTAGTTTAGTTAATGACAAAGAGAGGATACAGGAAGTT
AGGCAGAAAGCACTTGCTACCAGGGACAAATACCGGAGTGCATTCGCCACCAGTGGAACACACAGG
AGCCCAGGTGGCTATGACAATGACCGCTATGAAGGAAGCTATGGCAGTAGGTATGATAACAGAAAT
GGCTACGGGGGAGAAAGAGAGTATGGATATAGGGATGATGACAGATATGGTGTTGCTGGAACTACT
CCCAATCGGGAAGGAGATCGTTATTCTAGGGATTCTAATGAGCAGCGCTACAGCAGAGATAGAGAA
GATGAGTACAAAGGAAGTCATAGCAACCATGAATATGCAGAAGGATCAGGTCGCAGGAGCTATGGA
CGAGATAGGGATTCATATGGGGATGATGAAGCTTATTCATCCCGTGGCCGGCAAAGCAATGCTGAC
GGACCTACTCAGGATGAGAGGCCCATGGAGCGGAAGCCTTCTAACCAGCAGATTGCTTCACCACCG
CCAAACTATGAAGATGTCACAAGAGATACACAGGATAATAATCATGATGGACGAAATGGAGGGACT
GTGCCTGTGCCAGTTGCTGCAGCAAAGGTGTCTTCACCTCCAAGAACAAGTGTACCCCCAGGTCAG
GTGAATGGTGTACATGATAATACTGTGGAAGACGTACCTGCACCACCACCTACTCATCCTGAAGTT
AATGGGTTTGACGAGTTTGATCCTCGTGGATCAGTACCAGATACCTCACCTCCAGTGAACCCCTCA
CAAGCCGTGAATAGCTTGGAAATGGATTTATTCGGACCAGATCCTATTAATTCGTTGGCTTTGGTA
TCTGTGCCTCAGCCAACTGCCAGCCCAAATGTTGAGCCATCAGCAAATCCAGGATTTGAGAGTAAC
AGTTTTATGGGCATGCCACCGGCTTCTACTGGATTCAATGAGGCCTTTGATGCAACTAATCCTTTT
GGGGATCCTACGCCTTTCAAGGCTGTTCATGAAGAAACTCCTGCAGTTTCTCAGACAAATGCTGCA
CCTGCTGGTTCTTTCCATGCTACTGAACCTGCTGCAGATGCAAATCCTTTCCAGCCTGCTTCAGCA
GCAAGCTTTGGTTTTGGAGACACTCTTGGCGACCTCTCTTTTGGATCGAATGCTGCACCCGGGCAG
CAAGATATTTTTGTGCCCACCTCATCACATTCAGAGGTACCACCTGCAAACCCATCTGTGCACCCT
GAACAGGCAGTCCCATCTTATGTCTCCTCCCAGGCACCTCAGCCTGCAGCTGCTGGTCCACAAACT
CATGCTGCTCCCGCTTCATTTGCTTCTCAAGCACCTCCCACTTCATTTGCTTCTCAAGCACCTCAA
GCAGGGGCACCCTATCCTCAGGCTGCCTCCACATTTCCTCATTCACAAGCATCTCATCCTGCAGCC
ACTAATCCATCTACAATCCCTCAGAATGTTGCCACACCATTTGCTCCTTTACAAATGCCTCAACCT
GTACCATCAGGCCAATCAAACTATTTTATGCAACCAGTTCCAGGGACTGGCATTAATGGCATGTCT
GGGGCTCCTTCACAGAATGGAGCACCATCCTACATCCCTTCACAGGCTTCTCAATTTGCAGCTCCA
ACAAATCTACAGCCCTCTCAGCCAACCTTCCCCCCACAAACTGCCATGGCAGCTTCACAGGCAACA
TCAATTTCTCGAGGGGCATCTCAGCCTCTTGCAGTGCCGAATTCAATGCCTTCGGTGTGAACTTT
CCATTACAATCAAGTTCATCAGCTCCCCCTGAAACAATCCTTTCAGCCTTGCAAGTTAGTCAGTCT
GAGCCAGTGAAGAAATTTGAGTCCAAATCTACAGTTTGGGCTGATACATTGAGCCGAGGTTTAGTC
AATCTGGACATCTCTGGACCAAAGGCTAATCCGCACGCTGATATTGGAGTTGACTTCGATTCAATC
AATCGCAAGGAGAAAAGGCAAGAAAAGAAAGTCTCTCAAGCTCCTGTGGTATCTACGATCACTATG
GGCAAAGCCATGGGAACTGGCTCCGGCATCGGTCGGGCAGGTGCGAGTGCCATGGCACCTCCAGCC
AACCCAATGGGTGCAAGCAGGGGCATTGGCATGGGTATGGGCGCTGCTGGTTCCGGTTACGGTGGT
GGAATGGGAATGAACCGGCCAATGGGCATGGGAATGGGAATGAACCAACAAATGGGTATGGGAATG
```

FIGURE 7 (continued)

```
GGGATGAACCAACAGGCCATGGGAATGGGGATGAACCAACAGGCCATGGGAATGGGGATGAACCAA
CAACCAATGGGAATGAACATGGGCATGGGGATGAACCAGGGTATGGGAATGAACATGCGGCCTCCT
ATGGGAATGGGTCCAGGTAGTGGATATAATCCAATGGGTACCGGATACGGAGGGCAGCAACCATAT
GGTGGGTACAGGTGAGATTATACTGTACAATGCGATACTCAGTGAGGGGTTGAGAAACAGTTTAGG
AGGCGTTTGGATTTTGGTCACCTGGATTTTCTTTATGTATGGTTTCTTTTGTTTTGGGTGGGGGGG
GGGGGTTATAATTTTTCATCACTATTCTTTTCCTATCCATGTTGGATATTGTATCTACTAAATATA
TGACATGTGAACGGGGCAATGCTACAACTACTGTTGTGTTGGATGCAAAGCCTTAATACTATA
ATCATCAATGTAGCTGTATAATTCTCTATAGGATGTTTTTTTTCAGTAAACATTGTGATTGTTTC
AGCGTTCTTGCTGGCTTGACAATAAAAAGGCTGTACCATTTTGTTCAAGCTATCTTCCTTTCTTTT
TATGTCGTCACATTTTGAGGTGCAGACCTGCAGTTTTTGTGTCAGATGTCACCCGTCAGTCTGCAA
ATAGTAGTATATTTTTGCTCGTCCGAACTTTGGAACTACAGGAATGCCCATCTCTGCTGTCGCCT
CTTTTCTGTTCTGATGCGTGGTCACACAAGCCACTGTTGACACAGCAACTTTGTATCTCCATTATT
GACACAGCAACTTTGTATCTGATCATAATGAAACGAAGAATTTTGTGAGTTCAA
```

SEQ ID NO: 109, TC284943_8 [280 - 3114] deduced protein sequence, Oryza sativa (japonica cultivar-group)
MKKVFDQTVRDLKREVNKKVLKVPGIEQKILDATSNEPWGPHGSLLAEIAQATQNYHEYQMVMNVV
WKRINDTGKNWRHVYKGLIVLDYLVAHGTERVIDDIREHSYQISTLADFQYIDSSGRDQGSNVRRK
SQSLVSLVNDKERIQEVRQKALATRDKYRSAFATSGTHRSPGGYDNDRYEGSYGSRYDNRNGYGGE
REYGYRDDDRYGVAGTTPNREGDRYSRDSNEQRYSRDREDEYKGSHSNHEYAEGSGRRSYGRDRDS
YGDDEAYSSRGRQSNADGPTQDERPMERKPSNQQIASPPPNYEDVTRDTQDNNHDGRNGGTVPVPV
AAAKVSSPPRTSVPPGQVNGVHDNTVEDVPAPPPTHPEVNGFDEFDPRGSVPDTSPPVNPSQAVNS
LEMDLFGPDPINSLALVSVPQPTASPNVEPSANPGFESNSFMGMPPASTGFNEAFDATNPFGDPTP
FKAVHEETPAVSQTNAAPAGSFHATEPAADANPFQPASAASFGFGDTLGDLSFGSNAAPGQQDIFV
PTSSHSEVPPANPSVHPEQAVPSYVSSQAPQPAAAGPQTHAAPASFASQAPPTSFASQAPQAGAPY
PQAASTFPHSQASHPAATNPSTIPQNVATPFAPLQMPQPVPSGQSNYFMQPVPGTGINGMSGAPSQ
NGAPSYIPSQASQFAAPTNLQPSQPTFPPQTAMAASQATSISRGASQPLAVPNSMPSGVNFPLQSS
SSAPPETILSALQVSQSEPVKKFESKSTVWADTLSRGLVNLDISGPKANPHADIGVDFDSINRKEK
RQEKKVSQAPVVSTITMGKAMGTGSGIGRAGASAMAPPANPMGASRGIGMGMGAAGSGYGGGMGMN
RPMGMGMGMNQQMGMGMGMNQQAMGMGMNQQAMGMGMNQQPMGMNMGMGMNQGMGMNMRPPMGMGP
GSGYNPMGTGYGGQQPYGGYR

SEQ ID NO: 110, EAZ25008.1| hypothetical protein OsJ_008491 [Oryza sativa (japonica cultivar-group)], isoform of SEQ ID NO: 109
MKKVFDQTVRDLKREVNKKVLKVPGIEQKILDATSNEPWGPHGSLLAEIAQATQNYHEYQMVMNVV
WKRINDTGKNWRHVYKGLIVLDYLVAHGTERVIDDIREHSYQISTLADFQYIDSSGRDQGSNVRRK
SQSLVSLVNDKERIQEVRQKALATRDKYRSAFATSGTHRSPGGYDNDRYEGSYGSRYDNRNGYGGE
REYGYRDDDRYGVAGTTPNREGDRYSRDSNEQRYSRDREDEYKGSHSNHEYAEGSGRRSYGRDRDS
YGDDEAYSSRGRQSNADGPTQDERPMERKPSNQQIASPPPNYEDVTRDTQDNNHDGRNGGTVPVPV
AAAKVSSPPRTSVPPGQVNGVHDNTVEDVPAPPPTHPEVNGFDEFDPRGSVPDTSPPVNPSQAVNS
LEMDLFGPDPINSLALVSVPQPTASPNVEPSANPGFESNSFMGMPPASTGFNEAFDATNPFGDPTP
FKAVHEETPAVSQTNAAPAGSFHATEPAADANPFQPASAASFGFGDTLGDLSFGSNAAPGQQDIFV
PTSSHSEVPPANPSVHPEQAVPSYVSSQAPQPAAAGPQTHAAPASFASQAPPTSFASQAPQAGAPY
PQAASTFPHSQASHPAATNPSTIPQNVATPFAPLQMPQPVPSGQSNYFMQPVPGTGINGMSGAPSQ
NGAPSYIPSQASQFAAPTNLQPSQPTFPPQTAMAASQATSISRGASQPLAVPNSMPSGVNFPLQSS
SSAPPETILSALQVSQSEPVKKFESKSTVWADTLSRGLVNLDISGPKANPHADIGVDFDSINRKEK
RQEKKVSQAPVVSTITMGKAMGTGSGIGRAGASAMAPPANPMGASRGIGMGMGAAGSGYGGGMGMN
RPMGMGMGMNQQMGMGMGMNQQAMGMGINQQAMGMGMNQQPMGMNMGMGMNQGMGMNMRPPMGMGP
GSGYNPMGTGYGGQQPYGGYR

| | | |
|---|---|---|
| Acama_IPPT | (303) | ------------------------------- |
| Proma1375_IPPT | (300) | ------------------------------- |
| Proma9211_IPPT | (300) | ------------------------------- |
| Proma9215_IPPT | (300) | ------------------------------- |
| Proma9601_IPPT | (300) | ------------------------------- |
| Proma9301_IPPT | (300) | ------------------------------- |
| Proma9312_IPPT | (300) | ------------------------------- |
| Proma9515_IPPT | (300) | ------------------------------- |
| PromaMED4_IPPT | (300) | ------------------------------- |
| PromaNATL1A_IPPT | (300) | ------------------------------- |
| PromaNATL2A_IPPT | (300) | ------------------------------- |
| Proma9303_IPPT | (300) | ------------------------------- |
| Proma9313_IPPT | (300) | ------------------------------- |
| Synec7803_IPPT | (311) | ------------------------------- |
| Synec9311_IPPT | (311) | ------------------------------- |
| Synec8102_IPPT | (300) | ------------------------------- |
| Synec9605_IPPT | (300) | ------------------------------- |
| Synec9902_IPPT | (299) | ------------------------------- |
| Synec307_IPPT | (297) | ------------------------------- |
| Glovi_IPPT | (303) | ------------------------------- |
| SynecJA-3_IPPT | (341) | ------------------------------- |
| Theel_IPPT | (313) | ------------------------------- |
| Synec_IPPT | (307) | ------------------------------- |
| Anava_IPPT | (295) | ------------------------------- |
| Nossp_IPPT | (296) | ------------------------------- |
| Micae_IPPT | (312) | ------------------------------- |
| Synec6803_IPPT | (304) | ------------------------------- |
| Trier_IPPT | (310) | ------------------------------- |
| Escco_miaA | (317) | ------------------------------- |
| Homsa_IPPT | (455) | LKKRRRLDSDAVNTIESQSVSPDHNKEPKEKGSPGQNDQELKCSV |
| Sacce_MOD5_IPPT | (407) | LKRNTRQADFEKWKINKKETVE--------------------- |
| Arath_IPT2 | (446) | TTRHKNSQTYKNREVQEAEVN--------------------- |
| Consensus | (481) | |

FIGURE 10(continued)

SEQ ID NO: 143 Synechococcus sp. PCC 7942 tRNA delta-2-isopentenylpyrophosphate transferase Synec_IPPT nucleic acid sequence
ATGGAATCGCGTTTTGAAACCAGGTTTGATTGTCCTCTGTGGGCCAACGGCGGCAGGAAAATCGAGT
TTGGCGATCGCGATCGCCCAGCGTTTGGGCAGCCCAATTTTGAGTGCTGATTCGCGGCTGGTTTAT
CGCGACTTTAATATTGGCACCGCCAAGCCCACCCCTGCCGAGCAGCAGCAGGTGCCCCACTATTTA
ATGGATCTCTGTGATCCCCGCCAAGTTTTTACCGTTGGGGATTATCAAGATTGTGCAGTGCCACTG
ATTCAGCAACTCCAGGAAAAAGGAATGCTGCCCTTGTTGGTAGGGGGTACAGGTCTCTACATCAAA
GCGATCGTCAACGGTTTACGCTTTCCCCGCATTGCACCGCAGCCTAAGCTGCGATCGCAACTTCAA
GCGTTAGGTCAGCCACTCTGTCATGCCCTATTACAGCGGGTTGATCCGGTGGCTGGCGACCGAATT
CATGTCAGTGATCGCGTTCGGACCTTGCGAGCCTTAGAAGTCTTCTATGTCAGTGGCGATCGCCTG
ACGGATCTGCAGCAGGAGCAACCGCCGAGCTATCCAATTCTGCAGATTGGCTTGGATAGCGATCGC
TTAGAAGCCAGGATTCAGCAGCGCACCCAGCAGATGTTAACGTCGGGCTTCGTTGAGGAAGTGCAA
GGATTGTGCGATCGCTACGGTAGCGATCTGCCGCTGCTCAATACCCTGGGCTATCGCCAGGTTTGT
GCTTTTCTACAGGGAAGTTTGAGTCGGTCAGAGTTGCCAGAGCAAATCGTCCTGCAGACGCGCCAG
TATGCCAAACAGCAGCGCACTTGGTTCCGGGCCGATTCATCGATTCAGTGGATTGATGCCGAAGCC
AGCAATCGCCTGGAGCGGGCGCTAGACCTGATTGAGCGCTTCCGAAAGAGTGAGGGCGTTTGA

SEQ ID NO: 144 Synechococcus sp. PCC 7942 tRNA delta-2-isopentenylpyrophosphate transferase Synec_IPPT translated polypeptide sequence
MESRLKPGLIVLCGPTAAGKSSLAIAIAQRLGSPILSADSRLVYRDFNIGTAKPTPAEQQQVPHYL
MDLCDPRQVFTVGDYQDCAVPLIQQLQEKGMLPLLVGGTGLYIKAIVNGLRFPRIAPQPKLRSQLQ
ALGQPLCHALLQRVDPVAGDRIHVSDRVRTLRALEVFYVSGDRLTDLQQEQPPSYPILQIGLDSDR
LEARIQQRTQQMLTSGFVEEVQGLCDRYGSDLPLLNTLGYRQVCAFLQGSLSRSELPEQIVLQTRQ
YAKQQRTWFRADSSIQWIDAEASNRLERALDLIERFRKSEGV

SEQ ID NO: 145 Acaryochloris marina MBIC11017 tRNA delta-2-isopentenylpyrophosphate transferase Acama_IPPT nucleic acid sequence
ATGACGCCAGGGTTGATCGTAATTTGTGGGCCAACGGCTACCGGAAAATCCTCTCTGGCATTGGCT
TTGGCCCGACGTTTAGGTGCTCCCATTCTCAGTGCAGACTCTCGGCAAGTCTATCGGGGGTTTGAT
ATTGGTACTGCGAAACCTTCTGTAACGGATCAAGAAGATGTTCCTCACTATCTCATTGATATATGT
GACCCTACTGAGACTTTGACGGTTGCCGACTACCAAGAGCAGGCTCAGGCGCTCATTGCTCAGTTT
CATACTGAGGGCAAACGCCGATTCTCGTGGGGGGACTGGACTGTATATCCGGGCGATTGTGGAG
GGGCTGAAGATTCCGCGGGTACCGCCGCAACTGGAGTTGCGATCGCAACTCCAATCCCAAGGCCAG
GTCCAGATTTACCAATGGCTCCAGCAAGTCGATCCACCAGCAGCCCAAAAAATTCATGCCCATGAC
CAAGTCCGTACCCTAAGAGCATTAGAAGTCTTTTACACCACGGGCATCCCCCTATCAGCACAGCAA
GGCAAGAATCCCCCGTCCTATCCCATCTTGCAAATTGGCTTAGATATTAGTGATCTGGACCAGCAT
ACCGACATCATTCAGCAGCGCACGGCTGCCATGGTGGAGCAGGGTTGGTTGACTGAAGTCCAAAAA
CTCATCGACCACTATGGGGTCGAACTCCCCCTCTTAGCAACCCTGGGCTATCAAGAAATGAAGGCC
TATCTGCATCAGCAAATCACCCTAGAAGAAGCAACCGCCCAAACTATTCTTCATACTCGTCAATTC
GCCAAGCGCCAACGCACCTGGTTTAGAGCGAATTCTGGCATTCACTGGTTTGATGCCACGAATTCT
GACTTACTTTCTCTAGTTTGGAAGGATATTCAAGGTCAACCTTGGCTGTAA

FIGURE 12

SEQ ID NO: 146 Acaryochloris marina MBIC11017 tRNA delta-2-isopentenylpyrophosphate transferase Acama_IPPT translated polypeptide sequence
MTPGLIVICGPTATGKSSLALALARRLGAPILSADSRQVYRGFDIGTAKPSVTDQEDVPHYLIDIC
DPTETLTVADYQEQAQALIAQFHTEGQTPILVGGTGLYIRAIVEGLKIPRVPPQLELRSQLQSQGQ
VQIYQWLQQVDPPAAQKIHAHDQVRTLRALEVFYTTGIPLSAQQGKNPPSYPILQIGLDISDLDQH
TDIIQQRTAAMVEQGWLTEVQKLIDHYGVELPLLATLGYQEMKAYLHQQITLEEATAQTILHTRQF
AKRQRTWFRANSGIHWFDATNSDLLSLVWKDIQGQPWL SEQ ID NO: 147 Anabaena variabilis ATCC 29413 tRNA delta-2-isopentenylpyrophosphate transferase Anava_IPPT nucleic acid sequence
ATGACTAAATTAATCGTAATTTGTGGAGCTACGGCGACGGGTAAATCTGGTTTGGCTTTGAACTTA
GCCATGCGGTTGGGTTCTGTGATTTTGAGTGCTGATTCTCGTCAAGTGTATCGTGAATTTGATATT
GGTACAGCGAAGCCAACGCTGGCAGAACAAAAAGCCGTTCCTCATTATCTAATAGATATCTGCACT
CCCAGAGAAACGATGACAGTTGCAGATTATCAAGAACAGGCACAAGCACTAATTAATTCTCTGCCA
GTTTCGCCGTTATTGTTAGTGGGAGGTACTGGTTTATATATACGTTCTATTGTGCAGGGGATGAAG
ATCCCCAGGGTTGCGCCGAATTATGAATTGCGATCGCAACTCGAATCTTTAGGTCAAACTACACTC
TACGGCATATTACAACAAGTTGATCCCGTTGCGGCTCAAAAGATTCATCCCCATGATCCTGTACGG
ACTTTACGGGCAGTAGAAGTATTTTACGTTACTGGCATTCCCATATCGGCACAGCAAGGAGAAAAT
CCCCCAGATTACCCTATTTTACAAATTGGATTAGATTGTGAAATGGAAGATTGAGTGAGCGCATT
CACAAACGCACTGAACAAATGATAGCAGATGGCTTAGTTGGAGAAGTTGAATATCTGTGCCAAAAA
TATGGTGCTGATTTACCCTTGTTAAATACTTTAGGATATCAAGAAATTAAGCAATATTTAGCTGGA
GAAATTTCCTTAGAAGCAGCCAAAGAATTAATCGTACTGCATACAAGACAATTTGCCAAACGCCAA
CGCACCTGGTTTAGAGCCTATCCCCAAATTGAGTGGTTTAATGCAGATGATGCTGATTTATTAGAT
ATTGTTTGGCAGCGCATACAACAGTAG SEQ ID NO: 148 Anabaena variabilis ATCC 29413 tRNA delta-2-isopentenylpyrophosphate transferase Anava_IPPT translated polypeptide sequence
MTKLIVICGATATGKSGLALNLAMRLGSVILSADSRQVYREFDIGTAKPTLAEQKAVPHYLIDICT
PRETMTVADYQEQAQALINSLPVSPLLLVGGTGLYIRSIVQGMKIPRVAPNYELRSQLESLGQTTL
YGILQQVDPVAAQKIHPHDPVRTLRAVEVFYVTGIPISAQQGENPPDYPILQIGLDCEMERLSERI
HKRTEQMIADGLVGEVEYLCQKYGADLPLLNTLGYQEIKQYLAGEISLEAAKELIVLHTRQFAKRQ
RTWFRAYPQIEWFNADDADLLDIVWQRIQQ SEQ ID NO: 149 Gloeobacter violaceus PCC 7421 tRNA delta-2-isopentenylpyrophosphate transferase Glovi_IPPT nucleic acid sequence
GTGAAAAAAATCGTCGTCGTCTGCGGCCCCACCGCCGCCGGCAAAGCCAACTGGGAATGCATCTG
GCCCAGCACCTGGGGGTACCGGTGCTGAGCGCCGATTCCCGGCAGGTCTACCGCGAGTTCGACATC
GGCACTGCTAAACCGACCCGTGAAGAACAACGCCGCGTCGAGCACTGCCTCATCGATGTCGCCTGG
CCCACGGAACATTTCAACGTGGCGCGCTACCGGGAACTGGCCGATGCGGAGATTGACCGGCTGACC
CGGCAAGGCAAACCCGCCCTACTGGTGGGAGGCAGTGGTTTGTACCTGCGCGCGGTATCGGCGGA
CTCGAACCGCCCGCCGTCCCCCCCGACCCGGCTTTGCGCGCCCGCCTGGCGGTTGAGCGGTTGGAC
GCACTTACCAGCGACTTCAACAGCTCGATCCCGAATCCGCGGGGCGCATCCACCCCAACGACCAG
GTGCGCATCGAGCGCGCCCTCGAAGTGTGCCTGACAACCGGCCAACCGCTGAGTGCCCAGCGCCGC
CTGCGGGCGCGAGATTTTCGCTCCTCGCCCTGGGGGTGGGCAGCGGCCGGGAAGCGCTGGTGCGC FIGURE 12 (continued)

```
CGCATCGAGCAGCGCACCCACCGGATGATCGAAGCGGGTTGGCTGGAGGAAGTCGAGTATCTGCGC
GCCAAATACGGCCCCGATTTGCCGCTTCTGAGCACCCTCGGTTACGCCGAGTTGGGGGCGTACCTG
GAGGAGCGATGGGATCTGGCGGAGGCGCTCCAGCAGATCGTCGTGCATACCCGCCAGTTCGCCAAG
CGCCAGATGACCTGGTTTCGCGCCGAGCCCGATGTTCATTGGCTCGATGAATCGGCAGGACGGCAG
ACACTTGAACAACAGAGTATCGAACAGGTTGAGCGCTTTCTTGCCGGTTGA
```

SEQ ID NO: 150 Gloeobacter violaceus PCC 7421 tRNA delta-2-isopentenylpyrophosphate transferase Glovi_IPPT translated polypeptide sequence
```
MKKIVVVCGPTAAGKSQLGMHLAQHLGVPVLSADSRQVYREFDIGTAKPTREEQRRVEHCLIDVAW
PTEHFNVARYRELADAEIDRLTRQGKPALLVGGSGLYLRAVSGGLEPPAVPPDPALRARLAVERLD
ALYQRLQQLDPESAGRIHPNDQVRIERALEVCLTTGQPLSAQRRLRARDFSLLALGVGSGREALVR
RIEQRTHRMIEAGWLEEVEYLRAKYGPDLPLLSTLGYAELGAYLEERWDLAEALQQIVVHTRQFAK
RQMTWFRAEPDVHWLDESAGRQTLEQQSIEQVERFLAG
```

SEQ ID NO: 151 Microcystis aeruginosa PCC 7806 tRNA delta-2-isopentenylpyrophosphate transferase Micae_IPPT nucleic acid sequence
```
ATGTCAACTATTCTGATTGTTATTTGTGGGGCAACTGCCACAGGAAAATCCAGTTTAGCCCTACAA
TTGGCCAAAAAGTTTAATTCAGTAATTCTCAGTGCCGATTCCCGACAAATCTATCGAGAATTTAAT
ATTGGTACTGCTAAACCTAGCTTAGAAGAATGTCAGCGGATTCCCCATTATCTAATTGATATTTGT
GATCCTCAAGATAATTTTACCCTAGCACAGTACCAAGAACAGGCTGAGAATTTAATCAGCAATCTC
CACTATTCTCCTCTGTTTTTGGTCGGTGGTACGGGACTTTATATCAAGTCCATTGTCAAAGGTTTA
AAAATACCGAGGGTTTCTCCTCAAGCGGATTTAAGACGGCAATTACAAGCTTTAGGACAATCCTAT
CTTTATCAAATTCTGATGCAGGTAGATGAAGAGGCCGCTAAAAAAATTCATCCCCATGATCAGGTC
AGGACTTTACGCGCTTTAGAGGTTTTTTATGTGACAGGAAAACCTATCTCTAGTCAGCAGGGAGAA
AATCCCCCCACTTATCCGATTTTACAAATTGGTTTAGACTGTTCCCCAGAAAGTTTAGACAAGCGG
ATCACTGTTCGTACTCATCAAATGATCGCCAAGGGATTAGTAGCAGAGGTGCAGAATTTGGGGGAT
AAATACGGTTGGGATTTGCCACTTTTGCAGACTTTGGGTTATGCAGAGATTAAGCAATATCTCCTC
GGAGAAGTTTCTTTAGAACAGGCGATCGATCTAATTATCCTCCACACCCGTCAATTTGCCAAACGT
CAGCGCACTTGGTTTCGTGCCGATGCTGATATTGTCTGGTTTCCCGTCGATAAAGAAAATTTATTG
GAATTGGTGGAACGAAAAATTATTTTGTTTCTTGAGGGGTTGTCAAGGCCCGATATAAAAACACAT
CATCCTGATTAA
```

SEQ ID NO: 152 Microcystis aeruginosa PCC 7806 tRNA delta-2-isopentenylpyrophosphate transferase Micae_IPPT translated polypeptide sequence
```
MSTILIVICGDATATGKSSLALQLAKKFNSVILSADSRQIYREFNIGTAKPSLEECQRIPHYLIDIC
DPQDNFTLAQYQEQAENLISNLHYSPLFLVGGTGLYIKSIVKGLKIPRVSPQADLRRQLQALGQSY
LYQILMQVDEEAAKKIHPHDQVRTLRALEVFYVTGKPISSQQGENPPTYPILQIGLDCSPESLDKR
ITVRTHQMIAKGLVAEVQNLGDKYGWDLPLLQTLGYAEIKQYLLGEVSLEQAIDLIILHTRQFAKR
QRTWFRADADIVWFPVDKENLLELVERKIILFLEGLSRPDIKTHHPD
```

FIGURE 12 (continued)

SEQ ID NO: 153 Nostoc sp. PCC 7120 tRNA delta-2-isopentenylpyrophosphate transferase Nossp_IPPT nucleic acid sequence
ATGACTAAATTAATCGTAATTTGTGGTGCTACGGCGACAGGTAAATCTGGTTTGGCTTTGAACTTA
GCTATGCGGCTGGGTTCTGTGATTCTGAGTGCTGATTCTCGTCAAGTGTATCGTGAATTTGATATT
GGTACAGCGAAACCAACGCTAGCAGAACAAAGAGCCGTCCCTCATTATTTAATAGATATCTGCGCT
CCTAGAGAGACGATGACAGTTGCAGATTATCAAGAACAGGCACAAGCATTGATTAATTCTTTGCCA
GTCTCGCCGCTATTGTTAGTGGGAGGCACAGGTTTATATATACGTTCTATTGTGCAAGGGATGAAG
ATCCCCAGGGTTGCGCCGAATTATGAATTGCGATCGCAACTCGCCTCTCTAGGTCAAACTACACTC
TACGGCATATTACAACAAGTTGATCCCATTGCTGCCCAAAAAATTCATCCCAATGACCCTGTGCGA
ACTTTACGCGCAGTAGAAGTTTTTTACATTACTGGCATTCCCATATCGGCACAGCAAGGAGAGAAT
CCGCCAGATTACCCAATTTTACAGATTGGGTTAGATTGTGAAATGGAAAGACTGACTGAGCGGATT
CACAAACGCACTGAGCAAATGATAACAGATGGCTTAGTGGGAGAAGTTGAATATCTTTGCCAAAAA
TATGGTGCTGAGTTACCCTTGTTAAATACTTTAGGTTATCAAGAAATAAAGCAATATTTAACTGGG
GAAATTTCCTTAGAAGCAGCCAAAGAATTAACTGTTTTGCATACACGACAATTTGCCAAACGCCAA
CGCACCTGGTTTAGAGCATCTCCCCAAATTGAGTGGTTTAATGCAGATCATCCTGATTTATTAGAT
ATTGTTTGCCAGCACATACAACAACCGTAG

SEQ ID NO: 154 Nostoc sp. PCC 7120 tRNA delta-2-isopentenylpyrophosphate transferase Nossp_IPPT translated polypeptide sequence
MTKLIVICGATATGKSGLALNLAMRLGSVILSADSRQVYREFDIGTAKPTLAEQRAVPHYLIDICA
PRETMTVADYQEQAQALINSLPVSPLLLVGGTGLYIRSIVQGMKIPRVAPNYELRSQLASLGQTTL
YGILQQVDPIAAQKIHPNDPVRTLRAVEVFYITGIPISAQQGENPPDYPILQIGLDCEMERLTERI
HKRTEQMITDGLVGEVEYLCQKYGAELPLLNTLGYQEIKQYLTGEISLEAAKELTVLHTRQFAKRQ
RTWFRASPQIEWFNADHPDLLDIVCQHIQQP

SEQ ID NO: 155 Prochlorococcus marinus subsp. marinus str. CCMP1375 tRNA delta-2-isopentenylpyrophosphate transferase Proma1375_IPPT nucleic acid sequence
ATGCAAAACCCAAAACCATTGGTAATAGTTTTGCTTGGACCAACAGCAAGCGGGAAAACTGATCTA
GCTATACAAATAGCCAAAAAGATAAAGTAAGTATTCACAATATTGATTCACGTCAATTATATAAA
GGAATGAATATTGGTACTGCTAAACCAACGATAGAGCAGCAAGAAGAAATAAAGCATTATCTACTA
GATCTTAAAGATCCTAATAACCCCATCACATTGCATGAATTCAAAAAAGAAGCAGAGTTGAGCCTA
AAGAATATTTTTAGCAAAGAAAGTGTGGCTTTTTGGTCGGCGGAAGTGGCCTCTATTTAAAATCT
CTAACAAGTGGTTTATGCCCACCATCTGTTCCAGCACAAGAAAAACTCCGGAAAGAGTTTAGAAGA
CTTGGACAAAAAGAGTGTCATCAAATACTGAAAAAATGTGATCCCATTGCTTGGGAAAAAATTTCC
CCTAGAGATTCTATTAGAACAATAAGAGCATTAGAAGTTTTCTATTCCACTGGACAGACAATAAGC
TCATTAAAAACTTTAAAGCCTCCTGACTGGAATTTATTAGAGCTAGGGTTAGATCCAAGAAATCTT
CAACAAAGAATTGCTAAAAGAACAAAAATATTGTTCCAAAAAGGTCTTATTGATGAAACTAAAGCT
TTAATTCATCAATATGGAGAAGATCTTCCTTTGCTACAGACAATTGGATACAAAGAAGCTTGCACA
GTAATAAAAGGCGAATATTCAATTACAGAAGCAATCGAAATCACAACCCAACGAACGAATCAATTT
GCTAAGAAGCAAAGGACTTGGTTTAGAAGACAACATAATCCAAAATGGCTAAATGAAAAAAACTCT
CTTGAAGAAGCTCTCTCTTTGATCCAAAACGTTATAGGGTGA FIGURE 12 (continued)

SEQ ID NO: 156 Prochlorococcus marinus subsp. marinus str. CCMP1375 tRNA delta-2-isopentenylpyrophosphate transferase Proma1375_IPPT translated polypeptide sequence
MQNPKPLVIVLLGPTASGKTDLAIQIAKKIKVSIHNIDSRQLYKGMNIGTAKPTIEQQEEIKHYLL
DLKDPNNPITLHEFKKEAELSLKNIFSKEKCGFLVGGSGLYLKSLTSGLCPPSVPAQEKLRKEFRR
LGQKECHQILKKCDPIAWEKISPRDSIRTIRALEVFYSTGQTISSLKTLKPPDWNLLELGLDPRNL
QQRIAKRTKILFQKGLIDETKALIHQYGEDLPLLQTIGYKEACTVIKGEYSITEAIEITTQRTNQF
AKKQRTWFRRQHNPKWLNEKNSLEEALSLIQNVIG SEQ ID NO: 157 Prochlorococcus marinus str. MIT 9211 tRNA delta-2-isopentenylpyrophosphate transferase Proma9211_IPPT nucleic acid sequence
ATGTCGTCATCAAAACCACTCATAATTGTTCTCCTTGGACCTACTGCTAGCGGGAAAACTGCACTA
GGGATAGAAATAGCTGAGCATCTGGGACTCGAGATACATAATGTTGATTCTCGTCAGGTTTATATG
GATATGGACATCGGGACCGCAAAACCATCCCAAGAACAGCAAAAACGTATAAGACATTTCTTGATT
GATTTAAAGCCGCCTAATGAAAAAATGACAATGCATGATTTCCATAAAACAGCAAGAGTCAGCTTG
GATAATGCATTAAATAAAACAAACGTTGGATTACTTGTTGGTGGAAGTGGTCTGTATCTCAAAGCC
TTAACTAGCGGTCTATGCCCTCCATCCATTCCTCCCGAATCAAGTTTTAGGAAACAATTACATGAC
ATTGGTCAAGAGCAGTGTTATCAACTTCTCCAAAGCTGCGACCCACTGAGCGCGAAAACCATTGCT
CCATCAGACTCAGTCAGAACAACAAGAGCACTAGAAGTTTTTTATGCAACTGGTCAATCTAAAACT
TCCCTTCAATCTTCCAAACCACCTCCCTGGAGGTTATTAGAGCTAGGACTTAATCCAAGTAATCTC
AATGATCGCATTGCACAAAGAACAGAAAACATTTTTCAAAACGGTCTTATTGAAGAAACTGAACAC
CTCATTGGAAAATTTGGAAAGGAATTGCCCTTGCTAAACACTATTGGATATGCAGAGGCATCTCAA
ATGATTGATGGCAAGCTTCCCTTAAATGACGCCATATTTCAAACAAATAAAAGAACTAAGCAATTT
GCAAAAAGACAAAAAACTTGGTTTAGGGGTCAACACAATCCAAAATGGTTAAATGAGAAAAACCCA
CTTAGTGAAGCTCTCTCTTTGATCCATAACGTTATAAGGTGA SEQ ID NO: 158 Prochlorococcus marinus str. MIT 9211 tRNA delta-2-isopentenylpyrophosphate transferase Proma9211_IPPT translated polypeptide sequence
MSSSKPLIIVLLGPTASGKTALGIEIAEHLGLEIHNVDSRQVYMDMDIGTAKPSQEQQKRIRHFLI
DLKPPNEKMTMHDFHKTARVSLDNALNKTNVGLLVGGSGLYLKALTSGLCPPSIPPESSFRKQLHD
IGQEQCYQLLQSCDPLSAKTIAPSDSVRTTRALEVFYATGQSKTSLQSSKPPPWRLLELGLNPSNL
NDRIAQRTENIFQNGLIEETEHLIGKFGKELPLLNTIGYAEASQMIDGKLPLNDAIFQTNKRTKQF
AKRQKTWFRGQHNPKWLNEKNPLSEALSLIHNVIR SEQ ID NO: 159 Prochlorococcus marinus str. MIT 9215 tRNA delta-2-isopentenylpyrophosphate transferase Proma9215_IPPT nucleic acid sequence
ATGTCTTCATATCCAACTCCTGTAATAATTTTAATTGGGCCAACTGCAAGTGGCAAAACAGAATTA
GCTATTAAAATTGCAGAATATTTTAAAACTAGTATTCACAATATCGATTCGAGACAAATATATAAA
TTTATGGATATTGGAACCGCCAAGCCATCTAAAGACCAACAAAAAAAAATAAAGCATTTTTTAATA
GATATAGAGGAGCCAATCAATCAAATTAATGTGCAACAATTTCAAAAAATTGCTCAAAAATCAATA
AAAAGAGAAATAAATCAAGACAATCTACCTTTTCTTGTTGGGGGAGTGGTTTGTATATGAACTCA
ATAACAAAAGGTTTTTTTATACCAGATATTCCTCCTCAAAATAATTTGAGAATACAATTAGAAGAA
CTTGGCCAAAAAAAATGTTGGGAACTCTTAAATAATTGTGATCCATTATCAACAAAAAACATCAGT
TTTGCTGATCGCATTAGAACAATAAGAGCTTTAGAAGTTTTCTATGTAACGGGTAAACCTTTGTCA
ACTCTAAAAGTTCAAAATCCGCCTAATTGGAAAGTACTAGAGCTTGGATTAGATAGAGATAACTTA FIGURE 12 (continued)

```
AAAGAAAGAATTTTACAAAGAACAAAAAATATTTTTCTTTCGGGAATTATTGAAGAAACAAACCAC
CTTATCTCTAAATACGGATTTGATTTGCCAATATTAGAAACCATTGGTTATCGAGAAGCTAAGGAT
GTTTTAAAGAACCATTCAACAATCGACAAGGCGATTGAATTAACTACGACAAAAACGATCCAATTT
GCCAAAAGACAAAAAACTTGGTTTCGCAATAAAAATAATCCTATTTGGCTGAATAACAAAAACCTA
CTAAAAGATGCAATAATTAAGATAGAGTCTTTTTTAAGCTAA
```

SEQ ID NO: 160 Prochlorococcus marinus str. MIT 9215 tRNA delta-2-isopentenylpyrophosphate transferase Proma9215_IPPT translated polypeptide sequence
```
MSSYPTPVIILIGPTASGKTELAIKIAEYFKTSIHNIDSRQIYKFMDIGTAKPSKDQQKKIKHFLI
DIEEPINQINVQQFQKIAQKSIKREINQDNLPFLVGGSGLYMNSITKGFFIPDIPPQNNLRIQLEE
LGQKKCWELLNNCDPLSTKNISFADRIRTIRALEVFYVTGKPLSTLKVQNPPNWKVLELGLDRDNL
KERILQRTKNIFLSGIIEETNHLISKYGFDLPILETIGYREAKDVLKNHSTIDKAIELTTTKTIQF
AKRQKTWFRNKNNPIWLNNKNLLKDAIIKIESFLS
```

SEQ ID NO: 161 Prochlorococcus marinus str. MIT 9301 tRNA delta-2-isopentenylpyrophosphate transferase Proma9301_IPPT nucleic acid sequence
```
ATGTCTTCACATCCACCTCATGTAATAGTTTTAATTGGGCCTACTGCAAGTGGCAAAACAGAATTA
GCTATTGAAATTGCAGAATATTTTAAAACTAATATACACAATATCGATTCAAGGCAAATATATAAG
TCCATGGATATTGGAACAGCCAAGCCATCTAAAATCCAACAAAAAAAAATACGGCATTTTTTAATA
GATATTGAAGAACCTATCAATCCAATTAATGTAAAACAATTTCAAGAAATTGCTCAGAAATCGATC
AAAGAAGAAATTAAAAAAGATAAATTACCTTTTCTTGTTGGAGGAAGTGGTTTGTATATGAACTCA
ATAACAAAAGGTTTTTTCGTACCAGATGTCCCTCCTCAAAATAATTTAAGAAAACAATTAGAAGAA
CTTGGTCAGGAAAAATGTTGGGACCTGTTAGAAAATTGTGATCCATTATCAACAAAAAAATCAAT
TTTGCTGACCACGTTCGAACAATAAGAGCTTTAGAAGTCTTCTACGTAACAGGTAAGCCTTTATCA
ACTCTGAAAGTTCAGAAACCACCTAACTGGAAAATCTTAGAGCTTGGATTAGACAGAGGTAATTTA
AAAGAAGAATTTTTCAAAGAACAAAAAATATGTTTTTATCTGGAATAATTGATGAGACGAATCAC
CTTATCTCTAAATACGGATTTGATTTGCCAATATTAGAAACAATTGGCTATCGAGAAGCTAGAAAT
GTTTTAAATAACCATTCAACAATTGACAAAGCGATTGAGTTAACTGCAACAAAAACAATCCAATTT
GCCAAAAGACAAAAAACTTGGTTTCGTAATAAAAATAATCCTCTTTGGCTTAATAACAAAAACCCG
CTAAAAGATGCAATAATTAAGATAGAGTCTTTTTTAAGCTAA
```

SEQ ID NO: 162 Prochlorococcus marinus str. MIT 9301 tRNA delta-2-isopentenylpyrophosphate transferase Proma9301_IPPT translated polypeptide sequence
```
MSSHPPHVIVLIGPTASGKTELAIEIAEYFKTNIHNIDSRQIYKSMDIGTAKPSKIQQKKIRHFLI
DIEEPINPINVKQFQEIAQKSIKEEIKKDKLPFLVGGSGLYMNSITKGFFVPDVPPQNNLRKQLEE
LGQEKCWDLLENCDPLSTKKINFADHVRTIRALEVFYVTGKPLSTLKVQKPPNWKILELGLDRGNL
KERIFQRTKNMFLSGIIDETNHLISKYGFDLPILETIGYREARNVLNNHSTIDKAIELTATKTIQF
AKRQKTWFRNKNNPLWLNNKNPLKDAIIKIESFLS
```

SEQ ID NO: 163 Prochlorococcus marinus str. MIT 9303 tRNA delta-2-isopentenylpyrophosphate transferase Proma9303_IPPT nucleic acid sequence
```
ATGCCCGCCTCTAAGCCGCTTCTGATTGCGCTGCTAGGGCCGACAGCAAGCGGCAAAACATGCCTG
GCCTTACAGCTGGCAGAACAGCTGAAGCTGAGCGTGCTCAATGTGGATTCCCGCCAGCTCTACATC
GGCATGGACGTTGGCACCGCCAAGCCAACCAAAGAACAACAGCGGCGCGTGCAACATCACCTGATT
```

FIGURE 12 (continued)

```
GATCTTCGTCGCCCAGATCAACCGATCACCCTGCAGGAATTCCAGGCAGCCGCGCAACTGATCCTT
GCGCAAAAGCTAAGGGAACAAAACATGCCATTTCTAGTTGGCGGCAGTGGTCTTTATCTCAAAGCT
CTCACTTGTGGGCTGCGCCCACCAGCAGTGCCACCCCAACCAGAGCTCCGCAAGCAGTTAGGCGAG
CTAGGACAACGCACCTGCCACCACCTACTCCAAGCCGCCGATCCCACCGCTGCCAGCCGAATTGCC
CCTGCTGATGCCATGCGCACCAAACGGGCTCTGGAAGTGGTTTATGCCACTGGCAAACCGATCACC
ACTCAACAAGGCTCAAGCCCACCCCCTTGGCGCGTTCTGGAACTAGGCCTCGACCCACACAACCTG
CGCGAACGCATTGGCCAACGCACAACGCAGCTCTATGCCAATGGTCTCATCGAAGAAACCGAACAC
TTGAGTCAGTGCTACGACAGCGATCTGCCCTTGCTGCAAACAATCGGCTATGGGGAAGCACTAAAG
GTGATTCAAGGCCTACTCAACCGTGAACAGGCCATCGCCCTGACCACACGTCGTACTCAGCAGTTC
GCCAAGCGTCAGCGCACATGGTTCCGCAGACAACATCACCCCTATTGGCTCAAAGGTGAGGAACCG
CTGAGCGAAGCGCTATCACTGATTCAAGCGGGTCTAAGGTGA
```

SEQ ID NO: 164 Prochlorococcus marinus str. MIT 9303 tRNA delta-2-isopentenylpyrophosphate transferase Proma9303_IPPT translated polypeptide sequence
```
MPASKPLLIALLGPTASGKTCLALQLAEQLKLSVLNVDSRQLYIGMDVGTAKPTKEQQRRVQHHLI
DLRRPDQPITLQEFQAAAQLILAQKLREQNMPFLVGGSGLYLKALTCGLRPPAVPPQPELRKQLGE
LGQRTCHHLLQAADPTAASRIAPADAMRTKRALEVVYATGKPITTQQGSSPPPWRVLELGLDPHNL
RERIGQRTTQLYANGLIEETEHLSQCYDSDLPLLQTIGYGEALKVIQGLLNREQAIALTTRRTQQF
AKRQRTWFRRQHHPYWLKGEEPLSEALSLIQAGLR
```

SEQ ID NO: 165 Prochlorococcus marinus str. MIT 9312 tRNA delta-2-isopentenylpyrophosphate transferase Proma9312_IPPT nucleic acid sequence
```
ATGTCTTCTTATCCCCCTCATGTAATAGTTCTAATTGGAGCCACAGCAAGTGGGAAAACAGAATTA
GCTATCGAAATTGCAGAATATTTTAAAACTCGTATACATAATATCGATTCGAGACAAATTTATAAA
TCTATGGATATTGGAACAGCCAAACCATCTGAGAATCAACAAAAAAAAATAAAGCATTTTCTAATA
GATATAGAAGAACCTATTAATCCAATTAATGTAAAACAATTTCAAGAAATTGCTCAAAAATCAATA
CAAAAAGAAATTAAGCAAATAATTTACCTCTACTTGTTGGAGGAAGTGGTTTGTATATGAACGCA
ATAACCAAAGGTTTTTTTGTGCCGGATGTCCCTCCGCAAAATAATTTGAGAGAGCAATTGGAGGAA
CTTGGTCAAAAAGAATGTTGGGAGCTTTTAAAAAATTGTGATCCAATTTCGGCAAAAAAAATCAAT
CTTGCTGATCAAATTAGAACAATAAGAGCTTTGGAAGTATTTTATGTAACCGGTAAACCTTTATCT
TCTCAAAAAGTTCAAAAACCGCCTCAATGGAAAATACTAGAGCTTGGATTAAATAGAGATAATTTA
AAAGAAAGAATTTCACGAAGAACAAAAAATATGTTTTTATCTGGAATTATTGAAGAGACGAAAAAT
CTTATTTCTCGATATGGATCTGATTTACCAATATTAGAAACTATTGGTTACCGTGAAGCTAAAGAT
GTTTTAAATAATAATTTACCGATTGATAAGGCGATTGAGTTAACTAATATAAAAACGAACCAATTT
GCCAAAAGGCAGAAAACATGGTTTCGTAATAAAAATAATCCTATTTGGCTTAATAACAAAAACCTG
CTAAAAGATGCAATAATTAAGATAGAGTCTTTTTTAGACTAA
```

SEQ ID NO: 166 Prochlorococcus marinus str. MIT 9312 tRNA delta-2-isopentenylpyrophosphate transferase Proma9312_IPPT translated polypeptide sequence
```
MSSYPPHVIVLIGATASGKTELAIEIAEYFKTRIHNIDSRQIYKSMDIGTAKPSENQQKKIKHFLI
DIEEPINPINVKQFQEIAQKSIQKEIKQNNLPLLVGGSGLYMNAITKGFFVPDVPPQNNLREQLEE
LGQKECWELLKNCDPISAKKINLADQIRTIRALEVFYVTGKPLSSQKVQKPPQWKILELGLNRDNL
KERISRRTKNMFLSGIIEETKNLISRYGSDLPILETIGYREAKDVLNNNLPIDKAIELTNIKTNQF
AKRQKTWFRNKNNPIWLNNKNLLKDAIIKIESFLD
```

FIGURE 12 (continued)

SEQ ID NO: 167 Prochlorococcus marinus str. MIT 9313 tRNA delta-2-isopentenylpyrophosphate transferase Proma9313_IPPT nucleic acid sequence
ATGCCCGCCTCTAAGCCGCTTCTGATTGCGCTGCTAGGGCCCACAGCAAGCGGCAAAACATGCCTG
GCCTTACAGCTGGCAGAACAGCTGAAGCTGAGCGTGCTCAATGTGGATTCCCGCCAGCTCTACATC
GGCATGGACGTTGGCACCGCCAAGCCAACCAAAGAACAGCAGCGGCGTGTGCAGCATCACCTGATT
GATCTTCGTCGCCCAGATCAACCAATCACCCTGCAGGAATTTCAGGCAGCCGCGCAACTGATCCTT
GCGCAAAAGCTAAGGGAACAAAACATGCCATTTCTAGTTGGCGGCAGTGGTCTTTATCTCAAAGCT
CTCACTTGTGGGCTGCGCCCACCCGCAGTGCCACCCCAGCCAGAACTCCGCAAGCAGTTAGGCGAG
CTAGGCCAACGCACCTGCCACCACCTACTTCAAGCCGCCGATCCCACCGCTGCCAACCGAATTTCC
CCTGCTGATGCCATGCGCACTCAAAGGGGTCTGGAAGTGGTTTATGCCACTGGCAAACCGATCACC
ACTCAACAAGGCTCAAGCCCACCCCCTTGGCGCGTGCTGGAACTAGGCCTCGACCCACACAACCTC
CGCGAACGCATTGGCCATCGCACAACACAGCTCTATGCCAATGGTCTCATCGAAGAAACCGAACAC
TTGAGTCATTGCTACGACACCGATCTGCCCTTGCTGCAAACGATTGGCTATGGGGAAGCACTAAAG
GTGATTCAAGGCCTCCTCAACCGTGAACAGGCCATCGCCCTGACCACACGTCGTACTCAACAGTTC
GCCAAGCGTCAGCGCACATGGTTCCGCAGACAACATCACCCCTATTGGCTCAAAGGTGAGGAACCG
CTGAGCGAAGCGCTATCACTGATTCAAGCGGGTCTAAGGTGA SEQ ID NO: 168 Prochlorococcus marinus str. MIT 9313 tRNA delta-2-isopentenylpyrophosphate transferase Proma9313_IPPT translated polypeptide sequence
MPASKPLLIALLGPTASGKTCLALQLAEQLKLSVLNVDSRQLYIGMDVGTAKPTKEQQRRVQHHLI
DLRRPDQPITLQEFQAAAQLILAQKLREQNMPFLVGGSGLYLKALTCGLRPPAVPPQPELRKQLGE
LGQRTCHHLLQAADPTAANRISPADAMRTQRGLEVVYATGKPITTQQGSSPPPWRVLELGLDPHNL
RERIGHRTTQLYANGLIEETEHLSHCYDTDLPLLQTIGYGEALKVIQGLLNREQAIALTTRRTQQF
AKRQRTWFRRQHHPYWLKGEEPLSEALSLIQAGLR SEQ ID NO: 169 Prochlorococcus marinus str. MIT 9515 tRNA delta-2-isopentenylpyrophosphate transferase Proma9515_IPPT nucleic acid sequence
ATGCTTCCTTCAAAACCACTAGTAATAGTTTTAATCGGGCCGACAGCAAGTGGCAAAACTGAGCTA
GCAATAGATATCGCTAAATATTTTAATATCCATATACACAATGTAGATTCTAGACAAATTTATAGA
TTTATGGACATCGGCACAGCTAAACCAACGAAAGTTCAACAAAGAGCTATAAAGCATTTTTTAATA
GATGTTGAAGATCCCTCAGTAAAAGTAAATGCAAAGCAATTTCAAGAAATTGCCACAAAATCAATA
AATCGAGAATTAAATCAGAAAAAAACACCCTTTCTAGTTGGTGGTAGCGGATTATATATGAATTCA
ATAATAAAGGGATTTTTTGCACCAGATGTTCCTCCTCAAAGTTTTCTGAGGTCCCAATTCGAAAAA
TTAGGTCAAGAAAAATGTTGGGAACTTCTAAAAGTTTGTGACCCTGAATTAACAAAAACAATTAAT
TATGCCGATCAAATAAGAACCATAAGAGGTTTAGAAGTCTTTTATGTAACTGGTAAAAGAATGTCA
TCTCAAAGATTCCAAAACCCTCCTCCATGGAGAATCTTAGAATTGGGTATAAATAGAGTAGATTTA
AAGGAAAGAATTTTCAAAAGAACAAAAAACATGTTTGAATTTGGAATTATAGAGGAGACCAAAAAT
ATCATTAATCAATATGGATCGACTTTGCCTTTACTAGAAACGATTGGATATAAAGAGGCAAAAAAT
GTAATCAAAGAAATTTAACAATTGAAGAAGCTATTGAATTAACAACAACTAAAACAATCCAATTT
GCTAAAAGACAAAAAACATGGTTCCGTAATAAGAACAATGCAATATGGCTTAACAACAAAAACCTA
CTAAAAGATGCAATAATTAAGATAGAGTATGCTTTAGGTTAA FIGURE 12 (continued)

SEQ ID NO: 170 Prochlorococcus marinus str. MIT 9515 tRNA delta-2-isopentenylpyrophosphate transferase Proma9515_IPPT translated polypeptide sequence
MLPSKPLVIVLIGPTASGKTELAIDIAKYFNIHIHNVDSRQIYRFMDIGTAKPTKVQQRAIKHFLI
DVEDPSVKVNAKQFQEIATKSINRELNQKKTPFLVGGSGLYMNSIIKGFFAPDVPPQSFLRSQFEK
LGQEKCWELLKVCDPELTKTINYADQIRTIRGLEVFYVTGKRMSSQRFQNPPPWRILELGINRVDL
KERIFKRTKNMFEFGIIEETKNIINQYGSTLPLLETIGYKEAKNVIKENLTIEEAIELTTTKTIQF
AKRQKTWFRNKNNAIWLNNKNLLKDAIIKIEYALG SEQ ID NO: 171 Prochlorococcus marinus str. AS9601 tRNA delta-2-isopentenylpyrophosphate transferase Proma9601_IPPT nucleic acid sequence
ATGTCTAGAGACCTTCCTAATGTCATAATTTTGATTGGGCCTACTGCAAGTGGCAAAACAGAATTA
GCTATTGAAATTGCAGAATATTTTAAAACTCATATACATAATATCGATTCAAGGCAAATTTATAAG
TCCATGGATATTGGAACAGCCAAGCCATCTAAAAACCAACAAAAAAAAATCAAGCATTTTTTAATA
GATATTGAGGAGCCAATCCATCCAATTAATGTTAAACAATTTCAAGGAATTGCTCAAAAATCAATA
AAAAGTGAAATTAAACAAAATAATCTACCTTTTCTTGTTGGAGGTAGTGGGTTGTATATGAACTCG
ATAACAAAAGGTTTTTTTGTACCAGACGTCCCACCTCAAAATGATTTGAGAAAACAATTGGAAGAA
CTTGGTCAGAAAAAATGTTGGGACTTATTAAAAAATTGTGATCCATTATCAACAAAAAAATTAAT
TTTGCTGACCATATTAGAACAATAAGAGCTTTAGAAGTCTTTTACGTCACAGGAAAACCTTTGTCA
ACTTTGAAAGTGCAAAGGGCGCCTGACTGGAGAATACTAGAGCTTGGATTAGATAGAGATAATTTA
AAAGAAAGAATATTACAAAGGACAAAAAATATGTTTTCAGCGGGAATTATTGAAGAGACAAACTAC
CTCATCTCTAAATACGGATTTGATTTGCCAATATTAGAAACCATTGGATATCGAGAAGCTAAGGAT
GTTTTAAAAAACCATTCAACCATTGACAAAGCAATTGAGTTAACTACGACAAAAACTATCCAATAT
GCAAAAAGACAAAAAACTTGGTTTCGTAATAAAAATAATCCTCTTTGGCTTGATAACAAAAACCTT
CTAAAAGATGCAATAATTAAGATAGAGTCTTTTTTAAGCTAA SEQ ID NO: 172 Prochlorococcus marinus str. AS9601 tRNA delta-2-isopentenylpyrophosphate transferase Proma9601_IPPT translated polypeptide sequence
MSRDLPNVIILIGPTASGKTELAIEIAEYFKTHIHNIDSRQIYKSMDIGTAKPSKNQQKKIKHFLI
DIEEPIHPINVKQFQGIAQKSIKSEIKQNNLPFLVGGSGLYMNSITKGFFVPDVPPQNDLRKQLEE
LGQKKCWDLLKNCDPLSTKKINFADHIRTIRALEVFYVTGKPLSTLKVQRAPDWRILELGLDRDNL
KERILQRTKNMFSAGIIEETNYLISKYGFDLPILETIGYREAKDVLKNHSTIDKAIELTTTKTIQY
AKRQKTWFRNKNNPLWLDNKNLLKDAIIKIESFLS SEQ ID NO: 173 Prochlorococcus marinus str. MED4 tRNA delta-2-isopentenylpyrophosphate transferase PromaMED4_IPPT nucleic acid sequence
ATGTTCCAACCAAAACCATTAGTAATAGTTTTAATCGGACCTACAGCGAGTGGCAAAACTGAGCTA
GGAATCGAAATTGCTAAATATTTTAATCTCAATATACATAATGTCGACTCAAGACAACTTTATCGA
TTTATGGACATAGGTACAGCAAAGCCAACTAAAGAACAACAAAAAACAATAAAGCATTTTTTAATA
GATCTTGAAGAACCCTCTAGCCAAGTAAATGCAAAACAATTTCAAGAAATTGCTACCAAATCAATA
AATCGAGAACTAAATCAAAACAGAATTCCTTTTCTAATAGGCGGGAGCGGGCTATATATGAATTCA
ATAATAAAGGGTTTCTTTGCTCCGAATGTGCCCCCTCAAAAAGTTTTAAGATCACAATTCGAAAAA
CTAGGGCAAGAAAAATGTTGGGAACTTTTAAAAATTTGTGATCCTGTCTTAACAAAAAAATCAAT
TACGCTGATCAAGTTAGAACGATAAGAGCTTTAGAAGTCTTTTATGTAACGGGCAAACCAATATCC
TCTCAAAAATTCCAGAACCCTCCCCCATGGAAAATATTAGAATTAGGTCTATACAGAGAAGATTTA FIGURE 12 (continued)

```
AAAGAACGTATTTTCAAAAGAACAAAAAATATGTTTGAATTTGGAATTATAGATGAGACCAAAAAG
ATTATTAATCAATATGGATCAAATTTACCTTTACTAGAAACGATTGGATATAGAGAAGCCAAGGAT
GTAATAAAGGAAAATTTAAAACTTGAAAAAGCTATTGAAATAACTACAACAAAAACAATCCAATTT
GCTAAGAGACAAAAAACATGGTTCCGTAATAAAAACAATCCAATATGGCTTAATAACAAAAACCTA
CTAAAAGATGCAATAATCAATATAAAGCATGCATTACGCTAG
```

SEQ ID NO: 174 Prochlorococcus marinus str. MED4 tRNA delta-2-isopentenylpyrophosphate transferase PromaMED4_IPPT translated polypeptide sequence
```
MFQPKPLVIVLIGPTASGKTELGIEIAKYFNLNIHNVDSRQLYRFMDIGTAKPTKEQQKTIKHFLI
DLEEPSSQVNAKQFQEIATKSINRELNQNRIPFLIGGSGLYMNSIIKGFFAPNVPPQKVLRSQFEK
LGQEKCWELLKICDPVLTKKINYADQVRTIRALEVFYVTGKPISSQKFQNPPPWKILELGLYREDL
KERIFKRTKNMFEFGIIDETKKIINQYGSNLPLLETIGYREAKDVIKENLKLEKAIEITTTKTIQF
AKRQKTWFRNKNNPIWLNNKNLLKDAIINIKHALR
```

SEQ ID NO: 175 Prochlorococcus marinus str. NATL1A tRNA delta-2-isopentenylpyrophosphate transferase PromaNATL1A_IPPT nucleic acid sequence
```
ATGCAACCCAATAAGCCTCTTGTCATAGCCCTTATGGGCCCAACTGCAAGTGGTAAAACTGAACTT
GCAATTGATATTGCAAAAAAATCAATTCTAATATTCACAATATCGATTCTCGCCAAATCTATATT
GATATGGATATTGGCACCGCAAAGCCAACAGCAGTTCAACAAAGCCAAGTAAACCATTTCCTTATT
GATGTTTGCTTGCCATCTAAACCAATCAATCTTCATGATTTTCAATCCATAGCCCAAACATCCATT
GAGAGAGATTTAGAAAAAAAGGGTTTAACGTTACTTGTAGGAGGAAGTGGCTTATATCTTCAAGCC
TTAATTGGAGGACTTAATCCTCCAGCTGTACCTCCTCAGAAATTCTTAAGAGATCAACTTAAAAAA
ATCGATAAAACCGAACTACACAAATTATTAAAGCTTTGTGACCCTTTTTCAGCGCAGAGAATACAT
CCAGAAGACTCAATAAGAATCATTCGTGCTCTTGAAGTTTTTTATGCCACGGGAAAAATGTTTTCG
AAGGAAAAAAACATGACGCCTATTCCTTGGAGAGTGTTAGAACTTGGAGTAAATCCTGAAAATTTA
ATCAGTAGAATTCAACGTAGAACTGAAGAAATGTATAAAAAAGGTTTAATAGAAGAAACAGAAGAT
TTGATCAATAAATACGGAAAAAATTTACAGTTGCTTAAAACTATTGGATATGGTGAAGCAAGGTCT
ATGATTAATGGAAAGATTAATTATGAGGAGGCTTTAGAAATAACAATCAAACGAACTTGCCAATTA
GCCAAAAGACAAAAAACTTGGTTTAGAAATAAGCATCATTCTAAATGGCTAAATAATGAGAATGCA
TTACCCGAAGCTTTAACTTCTATCTATGAGTTTCTAGGTTGA
```

SEQ ID NO: 176 Prochlorococcus marinus str. NATL1A tRNA delta-2-isopentenylpyrophosphate transferase PromaNATL1A_IPPT translated polypeptide sequence
```
MQPNKPLVIALMGPTASGKTELAIDIAKKINSNIHNIDSRQIYIDMDIGTAKPTAVQQSQVNHFLI
DVCLPSKPINLHDFQSIAQTSIERDLEKKGLTLLVGGSGLYLQALIGGLNPPAVPPQKFLRDQLKK
IDKTELHKLLKLCDPFSAQRIHPEDSIRIIRALEVFYATGKMFSKEKNMTPIPWRVLELGVNPENL
ISRIQRRTEEMYKKGLIEETEDLINKYGKNLQLLKTIGYGEARSMINGKINYEEALEITIKRTCQL
AKRQKTWFRNKHHSKWLNNENALPEALTSIYEFLG
```

SEQ ID NO: 177 Prochlorococcus marinus str. NATL2A tRNA delta-2-isopentenylpyrophosphate transferase PromaNATL2A_IPPT nucleic acid sequence
```
ATGCAACCCAATAAACCTCTTGTCGTAGCCCTTATGGGCCCAACTGCAAGTGGTAAAACTGAACTT
GCGATTGATATTGCAAAAAAATCAATTCTAATATTCACAATATTGATTCTCGCCAAATTTATATT
GATATGGATATTGGCACCGCAAAGCCAACAGCAGTTCAACAAAGCCAAGTAAACCATTTCCTTATT
```

FIGURE 12 (continued)

```
GATATTTGCTTGCCATCTAAACCAATCAATCTTCATGATTTTCAATCCATAGCCAAAACATCCATT
GAGAGAGATTTAGAAAAAAGGGTTTAACTTTACTTGTAGGAGGAAGTGGTTTATATCTGCAAGCC
TTAATTGGAGGACTTAATCCTCCAGCGGTACCTCCTCAAAAATTCTTAAGAGATCAACTTAAAAAA
ATCGATAAAGCCGAACGACACAAATTATTAAAGCTTTGTGACCCTTTCTCAGCGCAGAGAATACAT
CCAGAAGACTCAATAAGAATAATTCGTGCTCTTGAAGTTTTTTATGCAACAGGAAGAATGTTTTCG
AAGGCTAAAAACATGAGGCCTACTCCTTGGAGAGTTTTGGAACTTGGATTAAATCCTGAAAATTTA
ACCAGTAGAATTCAACTTAGAACTAGAGAAATGTATAAAAAAGGGTTAGTAGAAGAAACAGGAGAT
TTGATCAATAAATACGGAAATAATTTACAGTTGCTTAAAACTATTGGATATGGTGAAGCAAGGTCT
ATGATTAATGGAAAGATTAATTATGAGGAGGCTTTAGAAATAACAATAAAACGAACTTGCCAATTA
GCCAAAAGACAAAAAACTTGGTTTAGAAATAAGCATAATTCTAAATGGCTAAATGATGAGAATGCA
TTACCCGAAGCTTTAGCTTCTATCTATGAGTTTCTTGGTTGA
```

SEQ ID NO: 178 Prochlorococcus marinus str. NATL2A tRNA delta-2-isopentenylpyrophosphate transferase PromaNATL2A_IPPT translated polypeptide sequence
```
MQPNKPLVVALMGPTASGKTELAIDIAKKINSNIHNIDSRQIYIDMDIGTAKPTAVQQSQVNHFLI
DICLPSKPINLHDFQSIAKTSIERDLEKKGLTLLVGGSGLYLQALIGGLNPPAVPPQKFLRDQLKK
IDKAERHKLLKLCDPFSAQRIHPEDSIRIIRALEVFYATGRMFSKAKNMRPTPWRVLELGLNPENL
TSRIQLRTREMYKKGLVEETGDLINKYGNNLQLLKTIGYGEARSMINGKINYEEALEITIKRTCQL
AKRQKTWFRNKHNSKWLNDENALPEALASIYEFLG
```

SEQ ID NO: 179 Synechococcus sp. JA-3-3Ab tRNA delta-2-isopentenylpyrophosphate transferase SynecJA-3_IPPT nucleic acid sequence
```
ATGGATCAAAACCGGTCTCCAAATGGGCGCGACTGTCGAGAACCTCCCTCCCCCTCCTCGACTGCA
AGGCCGGGGCTTGTCGTCATCGCTGGCCCCACGGCCACCGGCAAGTCGCGCCAGGCGCTGCTGTTG
GCCCAGCGGCTGGGATCCCCCCTGTTGAACGCCGACTCTCGTCAGGTGTACCGGGAGTTCGACATC
GGCACTGCCAAGCCCACTCCCGCCGAGCGGGCCCTCTGGCCCCACGAGTTGATTGACTTTGTGGAT
CCCCGCCACACCTATACAGTGGCCGAGTTTCAGCAGGCGGCCCAGGCGCGCATTGCCGCAGCCCAT
CGGCAGGGACAGACTCCTATTCTGGTGGGGGGCACAGGGCTCTACATTCAGTCGATCACGGCAGGC
TTAGGGATCCCGGCAGTTCCCCCCCAGCCTCAGTTGCGCGCTCAACTGGAGACGTGGCCGCCCGAG
ATCCGCTACGCCTGGCTGCAGCAGTTGGATCCTGTGGCAGCGGGGCAGATTCACCCTCATGATGAA
GTGCGCACCCTGCGGGCTTTGGAGATCATCTACACCACTGGGAAGCCGGCTTCCTACCTGCGGCAG
GCCCATCCTCCTGACTACCCCATTTTGCTCTTGGGGTTGCACTGCCCAATGCCCCGTCTGGAACAA
CGCATTGCCCGGCGCACAGCAGAAATGCTGGCGGCAGGCTGGATTGAGGAGGTAAAAACGCTGCGG
CAGCGCTACGGCCCAGACCTGCCCCTCTTGCAGACCTTGGGCTATGCGGAGATCGGCGCTTACCTG
GAAGGGCGGATCCCGGCAGCCGAGCTGCAGCCTCTGATTGTGCGGCGCACCCGCCAGTTTGCCAAG
CGGCAGATGACCTGGTTTCGGGCCATGCCAGGGATCCAGTGGCTGGACTGCGAGGCCGAGGATCTG
CCCGAACAGATCTGGAAGCGGGTTACAGCGTGGATGGCAGCTCAGACCAGCGCCGGAACCACTCCT
GCCGTCGCCGCGCGTCCGCCCGCCGATCCGTAA
```

SEQ ID NO: 180 Synechococcus sp. JA-3-3Ab tRNA delta-2-isopentenylpyrophosphate transferase SynecJA-3_IPPT translated polypeptide sequence
```
MDQNRSPNGRDCREPPSPSSTARPGLVVIAGPTATGKSRQALLLAQRLGSPLLNADSRQVYREFDI
GTAKPTPAERALWPHELIDFVDPRHTYTVAEFQQAAQARIAAAHRQGQTPILVGGTGLYIQSITAG
LGIPAVPPQPQLRAQLETWPPEIRYAWLQQLDPVAAGQIHPHDEVRTLRALEIIYTTGKPASYLRQ
AHPPDYPILLLGLHCPMPRLEQRIARRTAEMLAAGWIEEVKTLRQRYGPDLPLLQTLGYAEIGAYL
EGRIPAAELQPLIVRRTRQFAKRQMTWFRAMPGIQWLDCEAEDLPEQIWKRVTAWMAAQTSAGTTP
AVAARPPADP
```

FIGURE 12 (continued)

SEQ ID NO: 181 Synechocystis sp. RCC307 tRNA delta-2-isopentenylpyrophosphate transferase Synec307_IPPT nucleic acid sequence
ATGACCCCATTAATGGTGCTGGTTTTGGGCCCAACCGCCAGCGGCAAGACCAGCCTTGGCATTGCC
CTGGCCCAACAGCTCGATTGCCGGGTTCTCTCGATTGATTCGCGCCAGCTCTATGCAGGCATGGAC
ATCGGCACGGCCAAACCCACGCGCGACGAGCAGCAGCAGGCCCGCCACGAGCTGTTGAACCTGAGC
ACGCCCGATCAGCCCATCAACCTGCAGCAGTTCTGCTCCATGCCCAGACGCTGATTGAGCAAGAG
CAACAGCGGGGGCGGCCCGCGTTGCTGGTGGGCGGCAGCGGGCTGTATTTGCAAGCCTTGAGCCAA
GGGCTGCAGCCCCCGCCCTACCGCCACAAACGGGGCTGCGTCAGCAACTGCAGCAACTGGGGCAG
TCCTGTTGTCATCAGCTGCTGAGCCAGGCGGACCCTCAAGCCGCAGCCAAGATCGAGCCCAACGAT
CCAGTCCGCACACAGCGGGCACTGGAGGTGCTCTACGGAACCGGTCAAACCATCTCAAGCCAACAG
GGGCGCTGCCCGCCGGCCTGCCGGGTGCTGGAACTGGGGCTCAACCCCAGCGACCTCAAAGAGCGC
ATTGAGCAGCGCACAGCCTCCCTCTACGCCAGGGGCCTCGTGGCCGAAACCGAAACGCTCAGCAGG
CGCTACGGAGCTGATCTGCCCCTTCTGCAGACCATTGGTTACGGCGAAGCCCTGGCGGTACTCGCC
GGCAGGCTCAGCGAGTCCGAAGCGCAAGCACTCACCAGCCGGCGCACCTGGCTGTTTGCCAAACGC
CAACGCACCTGGTTCCGCAACCGCCATCAGCCCCTTTGGCTAAACACGGAATCCGCACTTGAAGAA
GCATTGGAAGCCATTGCAGCGGCCAGGTCTTAG SEQ ID NO: 182 Synechocystis sp. RCC307 tRNA delta-2-isopentenylpyrophosphate transferase Synec307_IPPT translated polypeptide sequence
MTPLMVLVLGPTASGKTSLGIALAQQLDCRVLSIDSRQLYAGMDIGTAKPTRDEQQQARHELLNLS
TPDQPINLQQFCSHAQTLIEQEQQRGRPALLVGGSGLYLQALSQGLQPPALPPQTGLRQQLQQLGQ
SCCHQLLSQADPQAAAKIEPNDPVRTQRALEVLYGTGQTISSQQGRCPPACRVLELGLNPSDLKER
IEQRTASLYARGLVAETETLSRRYGADLPLLQTIGYGEALAVLAGRLSESEAQALTSRRTWLFAKR
QRTWFRNRHQPLWLNTESALEEALEAIAAARS SEQ ID NO: 183 Synechocystis sp. PCC 6803 tRNA delta-2-isopentenylpyrophosphate transferase Synec6803_IPPT nucleic acid sequence
ATGGCCAAAGTTCCGCCCCTGATTGTTATTTGTGGCACCACCGCCAGTGGGAAATCCCAACTAGCC
CTTGATCTAGCCCAGCGGTTAAACGCAGTTATTTTGGGGGCCGATTCCAGGCAAATTTATAAAGAA
TTGGACATTGGCACCGCTAAACCCACCCTTGGCGATCGCCAAACGGTACCCCATTATCTGATTGAC
ATTTGTGAACCAACGGAAAACTTCACCCTAGCGGAATACCAACGGCAAGCCCAGGAGTTGATTGCG
TCATTAAACCAACCGATTCTGCTGGTAGGCGGCACTGGTTTATACATCCAGGCGATCGTCAAGGGG
TTAAAAATTCCTGCTGTTCCACCCCAGACCAATTTACGTGAACAGTTAGCTAACCTCGGCCAACCC
TTTTGTTATCAACTTTTAAGTCAAGTGGACCCCGTAGCCCAAAGCAAAATTGAACCCGCTGACGTG
GTGCGGACCCTGCGGGCTTTGGAAGTTTTCTATGCCACTGGGCGACCCATTTCCAGCCTACAAGGG
GAAAATCCCCCAGTTATCCCATTGTGCAAATCGGTTTAGGTCTGGAACCGGAGCAACTCCAACCC
AGAATTGTTCACCGTACCCATGCCATGGTTGAGGCGGGGTTAGTGAAGGAAGTTGAGGGTTTAATC
AATCAGTATGGGGAAGACCTACCCCTGCTCCATACCCTTGGTTACGCTGAGATTAAACAATATCTC
CAAGGTCAAATATCGTTAACTCAAGCGACGGAGTCCATCATTGTCCACACCAGGCAATTTGCCAAA
CGTCAGCGCACTTGGTTCCGCAAAGATTCGGCAATCCACTGGTTTGATGCTAACCAGCCAAACCTA
TTAGATTCGGTGACAAAGTTAGTACAAGTTGACGTAAACGAAGGAATGTTTTAA SEQ ID NO: 184 Synechocystis sp. PCC 6803 tRNA delta-2-isopentenylpyrophosphate transferase Synec6803_IPPT translated polypeptide sequence
MAKVPPLIVICGTTASGKSQLALDLAQRLNAVILGADSRQIYKELDIGTAKPTLGDRQTVPHYLID
ICEPTENFTLAEYQRQAQELIASLNQPILLVGGTGLYIQAIVKGLKIPAVPPQTNLREQLANLGQP
FCYQLLSQVDPVAQSKIEPADVVRTLRALEVFYATGRPISSLQGENPPSYPIVQIGLGLEPEQLQP
RIVHRTHAMVEAGLVKEVEGLINQYGEDLPLLHTLGYAEIKQYLQGQISLTQATESIIVHTRQFAK
RQRTWFRKDSAIHWFDANQPNLLDSVTKLVQVDVNEGMF SEQ ID NO: 185 Synechococcus sp. WH7803 tRNA delta-2-isopentenylpyrophosphate transferase Synec7803_IPPT nucleic acid sequence
ATGCCTCACACCAGCCCCGAAACGGAGGCCCAACGCGACAGCAACGCCCCCCTCGTGGTGGTGCTG
CTCGGACCCACCGCCAGCGGCAAAACCGCCCTCGCGCTGGAGCTGGCCGAGCGCTTCGACCTGGAG
ATCATCAATGTGGATTCCCGGCAGCTGTACCAGGAGATGAGCGTAGGCACGGCCAAGCCCAGCCCG
GAGCAACAGGCCCGCATCCGCCACCATCTGCTCGACCTGCGCCCCCCGACCAACCGATCACCTTG
CAGGAATTCCAGGAGGAAGCCCTCCAGGCGGTGAATCAGAGCCTGGCCAAACGCGGCGCCGCCTTT
CTCGTGGGCGGCAGCGGGCTCTATCTCAAGGCCCTCACAGCTGGTCTGCGCCCCCCGCTGTGGCG
CCCCAACCGGCGCTGCGCCGGCAACTGGCGCAGCTGGGCCAACCGCTGTGCCACCAGCTGCTCAAC
ACTGCCGATCCCGAGGCAGCCGTGCGCATCGCCAGCGCAGATGCGCTGCGCACCCAACGCGCCCTG
GAGGTGTTGTACGCCACAGGCGCACCGATGAGCCGCCAAACCAGTGCCAGTCCGCCGCCCTGGCGC
GTGCTGGAGCTGGGCCTCAATCCGCTCGACCTGCGCCAGCGCATCAGTGCACGCACCCAGGCGCTG
TACAGCCAAGGGCTGGTGGAGGAAACCCGCCAGCTGCGCGAGCGCTACGGCCCCGAGCTGCCGCTC
CTGCAAACCATTGGCTACGGCGAAGCGTTGCAAGTGCTCGCAGGCGATCTCAGCCGTCCCGCTGCG
ATCGCCCACACCACCCGGCGCACCCAGCAATTCGCCAAACGGCAGCGCACCTGGTTCCGGCGGCAG
CACCAGCCGCACTGGCTGCCCGATGACAATCCCCTGAATGAAGCCGGACGCCTGATCGAAGCGGGT
CTAGGCTGA SEQ ID NO: 186 Synechococcus sp. WH7803 tRNA delta-2-isopentenylpyrophosphate transferase Synec7803_IPPT translated polypeptide sequence
MPHTSPETEAQRDSNAPLVVVLLGPTASGKTALALELAERFDLEIINVDSRQLYQEMSVGTAKPSP
EQQARIRHHLLDLRPPDQPITLQEFQEEALQAVNQSLAKRGAAFLVGGSGLYLKALTAGLRPPAVA
PQPALRRQLAQLGQPLCHQLLNTADPEAAVRIASADALRTQRALEVLYATGAPMSRQTSASPPPWR
VLELGLNPLDLRQRISARTQALYSQGLVEETRQLRERYGPELPLLQTIGYGEALQVLAGDLSRPAA
IAHTTRRTQQFAKRQRTWFRRQHQPHWLPDDNPLNEAGRLIEAGLG SEQ ID NO: 187 Synechococcus sp. WH8102 tRNA delta-2-isopentenylpyrophosphate transferase Synec8102_IPPT nucleic acid sequence
TTGACGCAGCCAGAACCCTTGGTGATCACGTTGCTGGGGCCCACCGCCAGCGGCAAAACAGCCCTG
TCGCTGGAGATCGCTGAACGGCTCAATCTGCCGGTGATCAACGTGGATTCCAGGCAGCTGTACCGG
GAGATGACCGTGGGCACCGCCAAACCGACGGCGGAGCAACGGGCGCGGGTGCCACACCATTTGCTG
GATCTACGCAACCCCGATCAGCCGATCACCCTGCAGGAATTTCAGGCGGAGGCCGAGCCCTGCATC
CAGCGTGAGCTGCAAAGCAGGGGCATGGCACTGCTGGTGGGGGGTAGTGGCTTGTATCTCAAGGCC
CTCACCAGTGGCCTCAAACCACCGGCGGTGCCACCGCAGGCGCAGCTGCGTGAGCAGCTGAGCCAA
TTGGGTCAAGCGATCTGCCATCCGCTGCTCCAGCAGGCCGATCCAACGGCCGGCGCCAAGATCGCC
CCCGCTGATGCCGTACGCACCCAACGGGCTCTGGAGGTGCTGTACGCCACCGGTCGACCGATGAGC

```
AGCCAGGCCACAGCTACACCACCGCCCTGGCGGGTTTTGGAACTGGGGCTAGATCCTGCCAACCTG
CGCCAGCGCATTCAGCAGCGCACCGACCAGCTCTACAGCGACGGGTTGGTGGAGGAGACCCGGCAA
CTTTCGGAGCGCTACGGCGCTGATCTGCCATTGCTGCAGACCATTGGCTACGGCGAGGCCCTGCAG
CTCCTCGAAGGAACGATGAACCAGGCGAAAGCCAACCGAATCACCACCCAGCGCACGCGGCAATTC
GCCAAGCGTCAGCGCACCTGGTTCCGGCGCCAGCACCAGCCCCATTGGCTGGCGCCGGCTACAGAA
CTTGATCAGGCGATGACGTTGATCGAGCAGCATCTAAGGTGA
```

SEQ ID NO: 188 Synechococcus sp. WH8102 tRNA delta-2-isopentenylpyrophosphate transferase Synec8102_IPPT translated polypeptide sequence
```
MTQPEPLVITLLGPTASGKTALSLEIAERLNLPVINVDSRQLYREMTVGTAKPTAEQRARVPHHLL
DLRNPDQPITLQEFQAEAEPCIQRELQSRGMALLVGGSGLYLKALTSGLKPPAVPPQAQLREQLSQ
LGQAICHPLLQQADPTAGAKIAPADAVRTQRALEVLYATGRPMSSQATATPPPWRVLELGLDPANL
RQRIQQRTDQLYSDGLVEETRQLSERYGADLPLLQTIGYGEALQLLEGTMNQAKANRITTQRTRQF
AKRQRTWFRRQHQPHWLAPATELDQAMTLIEQHLR
```

SEQ ID NO: 189 Synechococcus sp. CC9311 tRNA delta-2-isopentenylpyrophosphate transferase Synec9311_IPPT nucleic acid sequence
```
ATGAATCAGATCAACTCTGAATTTGGCCCCGATGCCGGTGCAAAGGCACCCCTCGTTGTGGCGCTC
GTTGGGCCAACGGCGAGCGGCAAAACCGCGCTCGCGCTTGAGCTTGCTGAGCACTTCCAACTGGAG
ATCCTCAACATCGATTCTCGCCAGCTTTACCGAGAGATGGATATCGGCACGGCCAAACCCACAGCC
GAGCAACAACAGCGCGTCACCCATCACCTCCTCGACCTGCGCTCCCCTGATCAACCGATCACGCTT
CAGGAATTTCAGCAAGAAGCCACTGCGGCCGTGAGCCAGGTTCTCAAAGAGCGAGGCGTTGCTTTT
TTAGCTGGAGGCAGCGGCTTGTACCTCAAGGCTCTCACCCAAGGACTGCAGCCTCCAGCCGTGCCT
CCTCAAGCCGAGCTTCGCCGCCAGCTGAGCTCACTCGGTCAAGCGAACTGCCACCAGCTCCTCCAA
CAGGCCGATCCCCAAGCAGCCGCCAAGATCGCCCCTGCCGATGCGGTTCGCACCCAACGTGCTCTG
GAGGTGCTGTACTCCAGCGGCAAACCGATGAGCGCGCAACAGTCGACCAATCCCCCGCCCTGGCGC
GTACTGGAGCTCGGACTCAATCCCATGGAGCTGCGCTCACGCATCGCCCAACGGACTCTCCAGATT
TATCAGGAAGGCTTGCTTGAAGAAACGCGGCAGCTGAGCCAGCGCTATGGGCCTGACCTCCCCATG
CTGCAAACGATCGGCTACGGCGAAGCACTAGAGGTGCTGCAAGGAGGCCTAAGCGAAGCTCAGGCT
ATCGCTACCACCACCCGCCGCACCCAGCAGTTTGCCAAGCGTCAACGCACCTGGTTCCGCCGCCAA
CACAGTCCCCACTGGCTCACAGGTCAGGATGCCCTCAGCGAAGCGATACGTCTGATCGAAGCGGGT
CTAGGCTGA
```

SEQ ID NO: 190 Synechococcus sp. CC9311 tRNA delta-2-isopentenylpyrophosphate transferase Synec9311_IPPT translated polypeptide sequence
```
MNQINSEFGPDAGAKAPLVVALVGPTASGKTALALELAEHFQLEILNIDSRQLYREMDIGTAKPTA
EQQQRVTHHLLDLRSPDQPITLQEFQQEATAAVSQVLKERGVAFLAGGSGLYLKALTQGLQPPAVP
PQAELRRQLSSLGQANCHQLLQQADPQAAAKIAPADAVRTQRALEVLYSSGKPMSAQQSTNPPPWR
VLELGLNPMELRSRIAQRTLQIYQEGLLEETRQLSQRYGPDLPMLQTIGYGEALEVLQGGLSEAQA
IATTTRRTQQFAKRQRTWFRRQHSPHWLTGQDALSEAIRLIEAGLG
```

FIGURE 12 (continued)

SEQ ID NO: 191 Synechococcus sp. CC9605 tRNA delta-2-isopentenylpyrophosphate transferase Synec9605_IPPT nucleic acid sequence
TTGAACAGCTCCAACCCCCTGGTGATCACCCTGCTCGGGCCCACCGCCAGCGGCAAGACCGCCCTG
GCGTTGGACATCGCCGAACGGCTGGATCTGCCGGTGTTCAACGTGGATTCCCGCCAGCTCTACAGG
GAGATGGACATCGGAACCGCTAAGCCGACGGCGGAGCAACAGGCGCGGATACCGCACCATCTGCTG
GACCTGCGCACGCCCGATCAGCCGATCACGCTGCAGGAATTTCAGGCGATCGCCACCCCCTGCATC
AACGCTGCTCTAGAGCAGCGGGACGTGGCGCTGCTGGTGGGCGGCAGCGGCCTCTATCTCAAGGCC
CTCACCAGCGGTCTTCAGCCTCCTGCCGTGGCACCCCAGCCGCAACTGCGCCAGCAGCTGACGGCC
CTGGGCCAGCAGATCTGCCATCCCCTGCTGCAGGCCGCCGACCCCAAGGCCGCTGCCAAAATCGCC
CCTGCCGATGCCGTGCGCACCCAACGCGCCCTTGAGGTGCTCTACGGCTCCGGCAACCGATGAGC
CGGCAGGCCACAGCCGCCCCTCCGCCCTGGCGGGTGCTGGAACTGGGCCTCAACCCCGCCAACCTG
CGCCAACGCATCCAGCAACGTACCGAGCAGCTCTACCGCGATGGGCTGGTGGACGAGACCCAGCGC
CTGAGCGAGCGCTACGGCGCTGATCTGCCATTGCTGCAGACCATCGGCTACAGCGAAGCGCTGCAG
ATGATTGGCGGCAGCCTGACCACAACAGAAGCGGTGCGAATCACCAGCCAACGCACCCGCCAGTTC
GCCAAACGCCAACGCACCTGGTTCCGGCGTCAGCACAACCCCACTGGCTGCCCGACCAGGCAACG
CTGACGGATGCGATGACGTTGATCGAACAACATCTAAGGTGA SEQ ID NO: 192 Synechococcus sp. CC9605 tRNA delta-2-isopentenylpyrophosphate transferase Synec9605_IPPT translated polypeptide sequence
MNSSNPLVITLLGPTASGKTALALDIAERLDLPVFNVDSRQLYREMDIGTAKPTAEQQARIPHHLL
DLRTPDQPITLQEFQAIATPCINAALEQRDVALLVGGSGLYLKALTSGLQPPAVAPQPQLRQQLTA
LGQQICHPLLQAADPKAAAKIAPADAVRTQRALEVLYGSGQPMSRQATAAPPPWRVLELGLNPANL
RQRIQQRTEQLYRDGLVDETQRLSERYGADLPLLQTIGYSEALQMIGGSLTTTEAVRITSQRTRQF
AKRQRTWFRRQHNPHWLPDQATLTDAMTLIEQHLR SEQ ID NO: 193 Synechococcus sp. CC9902 tRNA delta-2-isopentenylpyrophosphate transferase Synec9902_IPPT nucleic acid sequence
ATGTCCACACAACCTCTCGTGATCACCTTGCTGGGGCCCACCGCCAGCGGCAAAACCGCCCTCGCC
CTTGAGCTGGCCGAACGGCTCGGGCTGCCAGTGATCAACGTGGATTCCCGCCAGCTGTATCGGGAG
ATGGACGTGGGCACCGCCAAACCCACAGCCGAACAACAGGCCCGGGTGACGCACCACTTACTCGAC
CTGCGCGATCCCAACCAGCCGATCACGCTGCAGGAGTTTCAAGCGGAAGCCACGCCCTGCATTGAG
CGTGAACTAAGCGAACGGGGCATCGCTCTACTTGTGGGGGGCAGCGGTTTGTACCTGAAAGCCTTA
ACAAGCGGTCTCAAACCACCAGCTGTGGGCCCGCAACCAGAGCTGCGTAAGCAATTCAGTGCCATG
GGACAAGCCGTCTGCCATCCGCTCTTGGCCGCCGCGGATCCAATAGCCGCTGCAAAAATTTCCCCT
GCGGATGTGGTCCGCACCCAGCGCGCCCTTGAGGTGCTCTACGCCTCAGGCCAACCGATGAGTGGT
CAGGCCAGCGTGGAACCTCCCCCCTGGAGAATTTTGGAACTCGGCCTAAATCCCACCAACCTGCGC
CAACGCATCAACCAACGCACTGAACAGCTGTATCAAGACGGATTAGTGGAGGAAACCCAACGCTTG
GCCGACCGCTACGGAGCCGACTTACCGCTGCTGCAAACGATCGGCTACGAGAAGCACTGCAAATC
AACGATGGATCGATCACAAGGCAGGCGGCGATCGCCACCACCTGCCAGCGCACACGGCAATTCGCC
AAACGTCAACGCACCTGGTTTCGGCGCCAACACACTCCCCAATGGCTCAGTGAACAGGATCTGTTA
ACGGAAGCGATGACGCTGATCGAACAACACCTAGGCTGA FIGURE 12 (continued)

SEQ ID NO: 194 Synechococcus sp. CC9902 tRNA delta-2-isopentenylpyrophosphate transferase Synec9902_IPPT translated polypeptide sequence
MSTQPLVITLLGPTASGKTALALELAERLGLPVINVDSRQLYREMDVGTAKPTAEQQARVTHHLLD
LRDPNQPITLQEFQAEATPCIERELSERGIALLVGGSGLYLKALTSGLKPPAVGPQPELRKQFSAM
GQAVCHPLLAAADPIAAAKISPADVVRTQRALEVLYASGQPMSGQASVEPPPWRILELGLNPTNLR
QRINQRTEQLYQDGLVEETQRLADRYGADLPLLQTIGYGEALQINDGSITRQAAIATTCQRTRQFA
KRQRTWFRRQHTPQWLSEQDLLTEAMTLIEQHLG SEQ ID NO: 195 Thermosynechococcus elongatus BP-1 tRNA delta-2-isopentenylpyrophosphate transferase Theel_IPPT nucleic acid sequence
GTGGGGGATGCAGGGCTAATTGTTATTGGGGGGCAACGGCTACAGGCAAAACGGCGCTAGCGATC
GCCCTTGCCCAACAATTGAATAGTGTCATTTTGAGTGCCGACTCCCGCCAAGTCTACCGCGGCTTT
GATATTGGCACAGCCAAGCCCACTCCAGCCCAGCAACAGCAGGTGCGCCATCACCTCATCGATATT
TGTGACCCCGCGAGACGCTGACCCTAGCAATTTACCAAGCCAAGGCTCAAGCCCTGATTGCCCAC
TACCACGCCCAAGGGATCACGCCCCTCTTGGTGGGGGGACAGGATTGTATATCCGCAGCATTACC
CAAGGGCTAACAATGCCCCAAGTCCACCGCAACCCCATCTACGGGCTCAATTGATGGCTCTGGGT
CAGCAGGAATGCTATCAGTGGCTTCAGCAGGTGGATCCTGTGGCGGCGCAACGGATCCATGCCCAC
GATCAAGTGCGTACCCTGCGAGCCTTGGAGGTCTATTACACCACTGGGGTGCCCCTCAGCCAGCAG
CAACGGCGCGAACCGCCTCCCTACCGGATTTGGTACTTTGCCCTCACGGGGGGCGATCGCCAGCAA
GAGCGCTGCCGTATTGAAGCCCGCACTCAGGAGATGCTAGCCATGGGCTGGCTCGATGAAATTCAG
CAACTGCAAAGGCAGTACGGCGAGGATTTGCCCCTCCTAGACACCTTGGGCTATCGGGAAATGCGC
CAATATCTGCGGGGAGAAGTCACCCTCGCGGAGGCTATTGCCCTCACAGTGCAGCACACCCAACAA
TTTGCCAAACGGCAGCGGACATGGTTCCGGGCAGAACCTGACATCCATTGGCTGCAAGCCACCACC
CTAGAGGCGCAACTGGCAGAGATTCAAGCACAATTCACTCTCTGTCCCAAGACCACTGCAACAAAG
CGGCGGATGAGCTGA SEQ ID NO: 196 Thermosynechococcus elongatus BP-1 tRNA delta-2-isopentenylpyrophosphate transferase Theel_IPPT translated polypeptide sequence
MGDAGLIVIGGATATGKTALAIALAQQLNSVILSADSRQVYRGFDIGTAKPTPAQQQQVRHHLIDI
CDPRETLTLAIYQAKAQALIAHYHAQGITPLLVGGTGLYIRSITQGLTMPQVPPQPHLRAQLMALG
QQECYQWLQQVDPVAAQRIHAHDQVRTLRALEVYYTTGVPLSQQQRREPPPYRIWYFALTGGDRQQ
ERCRIEARTQEMLAMGWLDEIQQLQRQYGEDLPLLDTLGYREMRQYLRGEVTLAEAIALTVQHTQQ
FAKRQRTWFRAEPDIHWLQATTLEAQLAEIQAQFTLCPKTTATKRRMS SEQ ID NO: 197 Trichodesmium erythraeum IMS101 tRNA delta-2-isopentenylpyrophosphate transferase Trier_IPPT nucleic acid sequence
TTGACTTTAATTACTATTTGCGGTCCAACTGCTACAGGTAAGTCTGGATTGGCCTTAGATTTGGCC
CATAGGTTGGGTTCAATAATTCTGAGTGCAGACTCCCGTCAGATATATAAATATTTTAACATTGGA
ACGGCAAAACCAACTATAAAAGAACAACAGTTAGTATCTCATTATTTAATAGATATCTGTGAACCT
ACAGAGATTTTGACTTTAGCAGAATACCAGAAACAGGCGCAAAGCTTTATTCAGTCTCCTGGTTCT
CAAACTGATGTGGTATTGCCAACATTATTGGTGGGGGTACTGGTTTATACATTAAGGCAATAGTT
AAGGGTTTGAAATTCCTAGGGTGGGGCCTAATGAAAGTTGCGATCGCAATTAGCAAATTTAGGT
CAAAAACAATGTTACAAAATGTTGCAGCAGGTTGATCAGGTTGCCGTTGAGAAAATTCACCCGAAT
GATGTGGTCCGAACTTTACGAGCATTGGAGGTATTTTATGTGAGTGGGAAACCAATTTCTCAACAG FIGURE 12 (continued)

```
CAGGGAGAAGACCTTCCAAATTATCCAATTTTGCAAATAGGGTTAGACTGTGATGTAGAAGTTTTG
GGGGAACGTATTCGTGATCGGACTGAGAAAATGGTGGAAGTTGGGTTAGTGGAGGAAGTCAAGTGT
TTGTGTGAAAAATATGGTGAGAAGTTGCCTTTATTAAATACTTTAGGTTATGCAGAAATGAAACAA
TATTTGGCGGGAGATATTTCCTTGGCTGAAGCGATCAAAGCAACAGTTTTACATACTCGTCAGTTT
GCCAAGCGACAACGCACTTGGTTTCGAGGATATCCAGAAATTGAATGGTTTGATGGGAATGCCCCA
AATTTATTGGACAAGGTTTGGGAGCGGGTGAGGGAGTTTACTAGAATACTGGCAGAAAAGACACAG
GAGTGA
```

SEQ ID NO: 198 Trichodesmium erythraeum IMS101 tRNA delta-2-isopentenylpyrophosphate transferase Trier_IPPT translated polypeptide sequence
```
MTLITICGPTATGKSGLALDLAHRLGSIILSADSRQIYKYFNIGTAKPTIKEQQLVSHYLIDICEP
TEILTLAEYQKQAQSFIQSPGSQTDVVLPTLLVGGTGLYIKAIVKGLKIPRVGPNEKLRSQLANLG
QKQCYKMLQQVDQVAVEKIHPNDVVRTLRALEVFYVSGKPISQQQGEDLPNYPILQIGLDCDVEVL
GERIRDRTEKMVEVGLVEEVKCLCEKYGEKLPLLNTLGYAEMKQYLAGDISLAEAIKATVLHTRQF
AKRQRTWFRGYPEIEWFDGNAPNLLDKVWERVREFTRILAEKTQE
```

SEQ ID NO: 199 ATP/GTP-binding motif A
```
G(P/A/T)TA(A/T/S)GK(S/T)
```

SEQ ID NO: 200 Conserved motif I
```
DSR(Q/L)(V/L/I)
```

SEQ ID NO: 201 Conserved motif II
```
(N/D/S/T)(I/V)GTAKP(T/S)
```

SEQ ID NO: 202 Conserved motif III
```
L(V/A/I)GG(S/T)GLY
```

SEQ ID NO: 203 Conserved motif IV
```
(F/Y/L)AK(R/K/Q)Q(R/K/M)TWFR
```

SEQ ID NO: 204 Oryza sativa dehydrin promoter
```
GTCACCACCGTCATGTACGAGGCTGCTCCACCACTGCCTCACTCGCCACCAGCGTCTCCCGCCGCG
TGCAATACAAGAAGAAACATCGAACGGTCATATAAGGTAAGACCCACTACCGATTTAACCTATCCT
TCCCACAATCTAATCCACTCATTTCTCCTCCCACGATCTTATTCTCTCATTTCTCCTCACTATTTT
TGCATTTGTAGGAAACACAATGACACCGTCGAAGAAAGCTGGTGGAGCACCGTAGCCAGCAATCAC
CAAAACACAGAGGGGAGGAGGTCGGCAGCGGCCATGCGGACGGCGACGAGACAACGTGACGCAAAG
AGGGAGGAGGACGTTGGCGATCATGCTGGTGTTGGCGGAGGAGGTCACTGGCCACGCGGATGACAG
CGGGGCAGCGCAACACAAAAGGGGGGAGGATGCCGGCGACCACGCTAGTGACCATGAAGCAAGAT
GATGTGAAAGGGAGGACCGGACGAGGGTTGGACCTCTGCCGCTGACATGAAGAGCGTGATGTGTAG
AAGGAGATGTTAGACCAGATGCCGACGCAACTAGCCCTGCAAGGTCACCCGACTGATATCGCTGCT
TGCCCTTGTCCTCATGTACACAATCAGCTTGCTTATCTCTCCATACTGGTCGTTTGTTTCCGTGG
CCGAAATAGAAGAAGACAGAGGTAGGTTTTGTTAGAGAATTTTAGTGGTATTGTAGCCTATTTGTA
ATTTTGTTGTACTTTATTGTATTAATCAATAAAGGTGTTTCATTCTATTTTGACTCAATGTTGAAT
CCATTGATCTCTTGGTGTTGCACTCAGTATGTTAGAATATTACATTCCGTTGAAACAATCTTGGTT
AAGGGTTGGAACATTTTTATCTGTTCGTGAAACATCCGTAATATTTTCGTTGAAACAATTTTTATC
GACAGCACCGTCCAACAATTTACACCAATTTGGACGTGTGATACATAGCAGTCCCCAAGTGAAACT
```

FIGURE 12 (continued)

```
GACCACCAGTTGAAAGGTATACAAAGTGAACTTATTCATCTAAAAGACCGCAGAGATGGGCCGTGG
CCGTGGCTGCGAAACGCAGCGTTCAGGCCCATGAGCATTTATTTTTTAAAAAAATATTTCACAACA
AAAAAGAGAACGGATAAAATCCATCGAAAAAAAAAACTTTCCTACGCATCCTCTCCTATCTCCATC
CACGGCGAGCACTCATCCAAACCGTCCATCCACGCGCACAGTACACACACATAGTTATCGTCTCTC
CCCCCGATGAGTCACCACCCGTGTCTTCGAGAAACGCCTCGCCCGACACCGTACGTGGCGCCACCG
CCGCGCCTGCCGCCTGGACACGTCCGGCTCCTCTCCACGCCGCGCTGGCCACCGTCCACCGGCTCC
CGCACACGTCTCCCTGTCTCCCTCCACCCATGCCGTGGCAATCGAGCTCATCTCCTCGCCTCCTCC
GGCTTATAAATGGCGGCCACCACCTTCACCTGCTTGCACACCACAGCAAGAGCTAAGTGAGCTAGC
CACTGATCAGAAGAACACCTCGATCTCTGAGAGTG
```

SEQ ID NO: 205 Oryza sativa proteinase inhibitor promoter
```
TTCTTCTGAAGCTGAAGCCCTGCGAAATAGGCCTTTAAACGCTTTAAGGTTACTGGATGATCATAT
CGGCGTAAGACCGGTTTAAACATGGTTTCGCTTTGTGAATCCAATGTGAGTCACGACGTGACACAT
GGCACGTCCTTGGAGCTTTAGACATATCGAATCTGAGCACTGGAGTGGCCGAGTGGGTGAGCGGCC
AAATCCGTTTTAGACAGATCGCACTGACACGATGTTGATCATTGATACTAATACCATTTTATCAAG
CAGTAGTGTTGAAAAAAAAACTTATGTTCTCTTCAACTGTGAGATTTCATCCCGTTTCAAGATGAA
CAAGCCATGCATGTGAGATGTGAACAGAAGGCAGAAGACAGTGGAAAGACAGGACAAATAAGTGAA
GAGGGATCAAATCAATGGGCCTGACGGTTTCTGAAAGTTGACATGGAAATCGCCGGTGATCACCGG
TTTATACGTTATTTAAATCTGCGATTTCCACTTTCGTTTGCTTTCGGGGTTCCGATTTGAGTCACG
CACATATTCTTCATCGTGCTTTGGATCTCAGCACCGTAGTAACTTTTGGACAAATTGCATTCGCCG
ACACTAATAACATGTTCTCTTTATGCTGCTTTACATATACTGCTTATCCACACCCAATCCCATGTT
CATATATTATGAGATGGAGGGAGTAAACTTTGTTAACAGCAACATTTTTTATATTAAAGCATCAAC
TAATTAAAGCACAAGATACGCATGTTATCTCAATAAATCTTCCAGTGCATGTATAAAGAAGATGTC
GCCGCTAACTTAGATAATTTTTGTGACCTTTATCCTGGCCGGCATAATTAATTCTTCCGGAAATTA
AAAGCTAGTTTTTCCATATTCATCAGTACAGACAAGACAGCATAGTAAGCGAAGCATACCTGACGT
GTTAGCTCATTGTAACTCGATCTGGAACACTCGATGCTAGACACAGACAGACACTCCTCGTGATGA
ACGTTAGCATTTAGCAACATACGGTGATAAAGCAGCTGGGGATCGATCCATCCATCCATCGTCTTT
ACACGTACTTACCTTGCTAACCGCACTGTCGACTCTTGCATGTTTGCATGTAATCCAAATGGACCC
CACGTGGAACATGCTCACAGTGCTTTGCAGCTGCTTTCCAAAATGCTTTCTTTCACTTCTTCCATT
CCTCTGTCCACAAAAAAAGTAGTGTGTTCTTGAGCCTATATAAGAGAGGGTCACACGCTCCAGTCG
ACTCACCATCGATCCATCTGACGGTTAGTTCCAAGGGAAAGAAGAA
```

SEQ ID NO: 206 Prm07646 sense
```
Ggggacaagtttgtacaaaaaagcaggcttaaacaatggaatcgcgtttgaaacc
```

SEQ ID NO: 207 Prm07645 reverse, complementary
```
ggggaccactttgtacaagaaagctgggttcaaacgccctcactctttcg
```

SEQ ID NO: 208, DNA - Arabidopsis thaliana
CAATGCTTTTTTATAATGCCAACTTTGTACAAAAAAGCAGGCTTAAACAATGGATACTCTCTTTAGAC
TAGTCTGTCTCCAACAACAACAACAATCCGATAGTATCATTACAAATCAATCTTCGTTAAGCAGAACT
TCCACCACCACTACTGGCTCTCCACAAACTGCTTGTCACTACAACTTTCCACAAAACGACGTCGTCGA
AGAATGCTTCAACTTTTTCATGGATGAAGAAGACCTTTCCTCTTCTTCTTCTCACCACAACCATCACA
ACCACAACAATCCTAATACTTACTACTCTCCTTTCACTACTCCCACCCAATACCATCCCGCCACATCA
TCAACCCCTTCCTCCACCGCCGCAGCCGCAGCTTTAGCCTCGCCTTACTCCTCCTCCGGCCACCATAA
TGACCCTTCCGCGTTCTCCATACCTCAAACTCCTCCGTCCTTCGACTTCTCAGCCAATGCCAAGTGGG
CAGACTCGGTCCTTCTTGAAGCGGCACGTGCCTTCTCCGACAAAGACACTGCACGTGCGCAACAAATC
CTATGGACGCTCAACGAGCTCTCTTCTCCGTACGGAGACACCGAGCAAAAACTGGCTTCTTACTTCCT
CCAAGCTCTCTTCAACCGCATGACCGGTTCAGGCGAACGATGCTACCGAACCATGGTAACAGCTGCAG
CCACAGAGAAGACTTGCTCCTTCGAGTCAACGCGAAAAACTGTACTAAAGTTCCAAGAAGTTAGCCCC
TGGGCCACGTTTGGACACGTGGCGGCAAACGGAGCAATCTTGGAAGCAGTAGACGGAGAGGCAAAGAT
CCACATCGTTGACATAAGCTCCACGTTTTGCACTCAATGGCCGACTCTTCTAGAAGCTTTAGCCACAA
GATCAGACGACACGCCTCACCTAAGGCTAACCACAGTTGTCGTGGCCAACAAGTTTGTCAACGATCAA
ACGGCGTCGCATCGGATGATGAAAGAGATCGGAAACCGAATGGAGAAATTCGCTAGGCTTATGGGAGT
TCCTTTCAAATTTAACATTATTCATCACGTTGGAGATTTATCTGAGTTTGATCTCAACGAACTCGACG
TTAAACCAGACGAAGTCTTGGCCATTAACTGCGTAGGCGCGATGCATGGGATCGCTTCACGTGGAAGC
CCTAGAGACGCTGTGATATCGAGTTTCCGACGGTTAAGACCGAGGATTGTGACGGTCGTAGAAGAAGA
AGCTGATCTTGTCGGAGAAGAAGAAGGTGGCTTTGATGATGAGTTCTTGAGAGGGTTTGGAGAATGTT
TACGATGGTTTAGGGTTTGCTTCGAGTCATGGGAAGAGGTTTTCCAAGGACGAGCAACGAGAGGTTG
ATACTAGAGCGTGCAGCGGGACGTGCGATCGTTGATCTTGTGGCTTGTGAGCCGTCGGATTCCACGGA
GAGGCGAGAGACAGCGAGGAAGTGGTCGAGGAGGATGAGGAATAGTGGGTTTGGAGCGGTGGGGTATA
GTGATGAGGTGGCGGATGATGTCAGAGCTTTGTTGAGGAGATATAAAGAAGGTGTTTGGTCGATGGTA
CAGTGTCCTGATGCCGCCGGAATATTCCTTTGTTGGAGAGATCAGCCGGTGGTTTGGGCTAGTGCGTG
GCGGCCAACGTAAAGGGTTGTTTTTATTTACCCAGCTTTCTTGTACAAAGTTGGCATTATAAGAAAGC
ATTGCTTATCAATTTGTTGCAACGAAC

SEQ ID NO: 209, protein - Arabidopsis thaliana
MDTLFRLVCLQQQQQSDSIITNQSSLSRTSTTTTGSPQTACHYNFPQNDVVEECFNFFMDEEDLSSSS
SHHNHHNHNNPNTYYSPFTTPTQYHPATSSTPSSTAAAAALASPYSSSGHHNDPSAFSIPQTPPSFDF
SANAKWADSVLLEAARAFSDKDTARAQQILWTLNELSSPYGDTEQKLASYFLQALFNRMTGSGERCYR
TMVTAAATEKTCSFESTRKTVLKFQEVSPWATFGHVAANGAILEAVDGEAKIHIVDISSTFCTQWPTL
LEALATRSDDTPHLRLTTVVVANKFVNDQTASHRMMKEIGNRMEKFARLMGVPPKFNIIHHVGDLSEF
DLNELDVKPDEVLAINCVGAMHGIASRGSPRDAVISSFRRLRPRIVTVVEEEADLVGEEEGGFDDEFL
RGFGECLRWFRVCFESWEESFPRTSNERLILERAAGRAIVDLVACEPSDSTERRETARKWSRRMRNSG
FGAVGYSDEVADDVRALLRRYKEGVWSMVQCPDAAGIFLCWRDQPVVWASAWRPT

SEQ ID NO: 210, DNA - Arabidopsis thaliana
ATGGATACTCTCTTTAGACTAGTCAGTCTCCAACAACAACAACAATCCGATAGTATCATTACAAATCA
ATCTTCGTTAAGCAGAACTTCCACCACCACTACTGGCTCTCCACAAACTGCTTATCACTACAACTTTC
CACAAAACGACGTCGTCGAAGAATGCTTCAACTTTTTCATGGATGAAGAAGACCTTTCCTCTTCTTCT
TCTCACCACAACCATCACAACCACAACAATCCTAATACTTACTACTCTCCTTTCACTACTCCCACCCA
ATACCATCCCGCCACATCATCAACCCCTTCCTCCACCGCCGCAGCCGCAGCTTTAGCCTCGCCTTACT

FIGURE 17

```
CCTCCTCCGGCCACCATAATGACCCTTCCGCGTTCTCCATACCTCAAACTCCTCCGTCCTTCGACTTC
TCAGCCAATGCCAAGTGGGCAGACTCGGTCCTTCTTGAAGCGGCACGTGCCTTCTCCGACAAAGACAC
TGCACGTGCGCAACAAATCCTATGGACGCTCAACGAGCTCTCTTCTCCGTACGGAGACACCGAGCAAA
AACTGGCTTCTTACTTCCTCCAAGCTCTCTTCAACCGCATGACCGGTTCAGGCGAACGATGCTACCGA
ACCATGGTAACAGCTGCAGCCACAGAGAAGACTTGCTCCTTCGAGTCAACGCGAAAAACTGTACTAAA
GTTCCAAGAAGTTAGCCCCTGGGCCACGTTTGGACACGTGGCGGCAAACGGAGCAATCTTGGAAGCAG
TAGACGGAGAGGCAAAGATCCACATCGTTGACATAAGCTCCACGTTTTGCACTCAATGGCCGACTCTT
CTAGAAGCTTTAGCCACAAGATCAGACGACACGCCTCACCTAAGGCTAACCACAGTTGTCGTGGCCAA
CAAGTTTGTCAACGATCAAACGGCGTCGCATCGGATGATGAAAGAGATCGGAAACCGAATGGAGAAAT
TCGCTAGGCTTATGGGAGTTCCTTTCAAATTTAACATTATTCATCACGTTGGAGATTTATCTGAGTTT
GATCTCAACGAACTCGACGTTAAACCAGACGAAGTCTTGGCCATTAACTGCGTAGGCGCGATGCATGG
GATCGCTTCACGTGGAAGCCCTAGAGACGCTGTGATATCGAGTTTCCGACGGTTAAGACCGAGGATTG
TGACGGTCGTAGAAGAAGAAGCTGATCTTGTCGGAGAAGAAGAAGGTGGCTTTGATGATGAGTTCTTG
AGAGGGTTTGGAGAATGTTTACGATGGTTTAGGGTTTGCTTCGAGTCATGGGAAGAGAGTTTTCCAAG
GACGAGCAACGAGAGGTTGATGCTAGAGCGTGCAGCGGGACGTGCGATCGTTGATCTTGTGGCTTGTG
AGCCGTCGGATTCCACGGAGAGGCGAGAGACAGCGAGGAAGTGGTCGAGGAGGATGAGGAATAGTGGG
TTTGGAGCGGTGGGGTATAGTGATGAGGTGGCGGATGATGTCAGAGCTTTGTTGAGGAGATATAAAGA
AGGTGTTTGGTCGATGGTACAGTGTCCTGATGCCGCCGGAATATTCCTTTGTTGGAGAGATCAGCCGG
TGGTTTGGGCTAGTGCGTGGCGGCCAACGTAA
```

SEQ ID NO: 211, protein - Arabidopsis thaliana
MDTLFRLVSLQQQQQSDSIITNQSSLSRTSTTTTGSPQTAYHYNFPQNDVVEECFNFFMDEEDLSSSS
SHHNHHNHNNPNTYYSPFTTPTQYHPATSSTPSSTAAAAALASPYSSSGHHNDPSAFSIPQTPPSFDF
SANAKWADSVLLEAARAFSDKDTARAQQILWTLNELSSPYGDTEQKLASYFLQALFNRMTGSGERCYR
TMVTAAATEKTCSFESTRKTVLKFQEVSPWATFGHVAANGAILEAVDGEAKIHIVDISSTFCTQWPTL
LEALATRSDDTPHLRLTTVVVANKFVNDQTASHRMMKEIGNRMEKFARLMGVPFKFNIIHHVGDLSEF
DLNELDVKPDEVLAINCVGAMHGIASRGSPRDAVISSFRRLRPRIVTVVEEEADLVGEEEGGFDDEFL
RGFGECLRWFRVCFESWEESFPRTSNERLMLERAAGRAIVDLVACEPSDSTERRETARKWSRRMRNSG
FGAVGYSDEVADDVRALLRRYKEGVWSMVQCPDAAGIFLCWRDQPVVWASAWRPT

SEQ ID NO: 212, DNA - Pinus taeda
```
ATGGATAGATTGTTCACCTCCAGATTAGCAGATTATCAATCCGAACACCCTCTGTCATGCTTCAATTC
TAACAAAAATTGTGAAGATGCAGACACCCCTAGACACATAGACAGCTACAACAACCATCTCAGCCAGT
TTGTTCTCCCATCCAGAAGGGATAAATCAAGGCAATGCAATTCTTTCATGGAGGACGAAGACTTCTCA
TTCAAGCAATTCCTTCCTTTCAAAGAAATGTTCAACAGCAATCAGACCGGAAAGGGTACCACGGGACC
TAACCAATTTAGCGGCACTAGGGCTACTTCTAGCAGATCAAGTGAAGTACCAGACCCCAGCTTGTTTT
CTGAACTGAACCCTAATTTTCCAGAGGAGTTTGGACCAGCAGGATCACGTCGATGGGCTTCAAATCTT
CTGCTAGAATGTGCCAGAGCAATAGCAGAGAATGAAAAAGCCGAACCCAACATCTGCTATGGATGCT
AAATGAACTATCATCTCCCTATGGGGATTGTGAGCAGAAATTGGCCTCGTACTCTTGCAGGCCTTTT
TTTGCAAAATAACAGATACTGGTCCTCGTTGCTACACCACACTTTGTTCAGCTGCTGAAAAAACATAC
TCATTTGATTCCACAAGAAAAATGATCTTGAAATTCCAGGAATCAAGCCCATGGACAACCTTTGGTCA
TGTTGCTGCCAATGGAGCAATCCTGGAGTCCTTTGAGGGAGAAATGAAGCTGCACATAGTTGACCTGA
GCAACACTTTTTGCACACAGTGGCCTACTTTGTTAGAGGCCTTGGCCACCAGAAGTGATGACACCCCT
CATCTTAGGTTGACTACTGTAGTCACCAGCAAGGAAGCCACAGCAATGAAGGTCATGAAGGAAATAGG
```

FIGURE 17 (continued)

```
GCAAAGAATGGAGAAATTTGCACGGCTCATGGGGGTTCCATTTGAATTCAGTGTTATTCATCAACAAC
ATCTCCACAAGCTCAACGTTGGTGCCCTTAAAATCAGACCAGATGAAGCTCTGGCCATCAACTGCATC
CACAGCCTGCAACGTGTTATCAAGAATGGAAGGGATTCCATATTGTCCACGTTCTACAGCATGAACCC
CAAGATAGTTACTGTTGTAGAGGACGAAGTAGACCTGACTCATGAAGATTTTGGTGATTGTTTTAGTG
AATGCCTTCGTTTTTTTTCCTTGTTTTTTGATTCTCTAGAGGAGAGCTTCTCCAGAACCAGCAACGAG
AGATTAATGCTTGAAAGAACCAGTGCAAGGAGCATTGTGAACATATTGGCCTGTGAGGATTCTGAAGT
TTATGAGCGCAGGGAAAAGGGTGCACAGTGGGCTTGGAGGCTCAAGGAGGCAGGATTTATACATGCTG
CATTCAGTGATGATGTTGTTGATGATGTTAGGGCTCTTCTCAAGAGATACAAGGAGGGTTGGGGTCAC
TGTAGCAATTCAGATGGGCTTTTCTTGACCTGGAAGGAGCAGTGCGCCATTTGGGCTTCTGCCTGGAA
GCCATGCTTGTAA
```

SEQ ID NO: 213, protein - Pinus taeda
```
MDRLFTSRLADYQSEHPLSCFNSNKNCEDADTPRHIDSYNNHLSQFVLPSRRDKSRQCNSFMEDEDFS
FKQFLPFKEMFNSNQTGKGTTGPNQFSGTRATSSRSSEVPDPSLFSELNPNFPEEFGPAGSRRWASNL
LLECARAIAENEKSRTQHLLWMLNELSSPYGDCEQKLASYFLQAFFCKITDTGPRCYTTLCSAAEKTY
SFDSTRKMILKFQESSPWTTFGHVAANGAILESFEGEMKLHIVDLSNTFCTQWPTLLEALATRSDDTP
HLRLTTVVTSKEATAMKVMKEIGQRMEKFARLMGVPFEFSVIHQQHLHKLNVGALKIRPDEALAINCI
HSLQRVIKNGRDSILSTFYSMNPKIVTVVEDEVDLTHEDFGDCFSECLRFFSLFFDSLEESFSRTSNE
RLMLERTSARSIVNILACEDSEVYERREKGAQWAWRLKEAGFIHAAFSDDVVDDVRALLKRYKEGWGH
CSNSDGLFLTWKEQCAIWASAWKPCL
```

SEQ ID NO: 214, DNA - Physcomitrella patens
```
TGGGCCAAAGCTCTTCTTCTGGACTGTGCAAGAGCTATAGCTGAGAAAGACACTTCGCGCGTTCAAAG
CATTATGTGGATTTTGAACGAGAGTGCATCTCCATACGGAGATTCCGACCAAAGACTTATGTCATATT
TCGTCCAAGCACTTGTCTGCAAGATCACAGACACGGGCTCTCGATGCCACCGAAGTCTAACTTCCGCC
GCCGAAAAGACGTATTCCTTTGAATCGATGCGAAATATGATCCTTAACTTTCAGCAGAATGCGAGCCC
CTGGACAACTTTTGGGCATGTTGCTGCAAACGGAGCTCTTCTGGAGACGATGGAAGGGGAGTCCAAGA
TACATATCATTGACATCAGCAGTACATTGTGTACGCAATGGCCAACCTTTCTGGAAGCTCTAGCAACG
CGGACGGATATAACCCCTCACCTCCGCCTCACATGCATCGTGATATCACCCGAAGAAGCAGCGTTGAG
GGTGATGAAACAAGTCATGAACAGAATAGACAGGTTTGCCAGACTGATGGGAGTGCCGTTCGAGAGCA
CGGTGATCCATAAACCTCACTTGGAAACGTTGGATCTGGATGAGCTGAACTTGCGGGAAGGTGAAGCT
CTCGCTGTGAATTGCGTTCAGACTCTACACCACATCTCCGAGTGTGTAGCAGCCGAGGAGCAGTACAG
TCCTCGAGACCGAATTCTGTCCACTTTCCGGAGTGCCAAACCCAAGATTCTGTCGATCGTGGAGGATG
AAGCTAACATGATCTCACCAGACTTCCTTGGTTGCTTCCGGGAGGCCCTTAGATTTTACTCGCTCTTA
TTTGAATCTTTGGAGGAGAGCTTTCCCCGAGCCAGCAACGAGCGTCTCATGCTTGAGCGAAATTGCGC
CCGCAAGCTGGTGAATATGCTAAGTTTTGACGCCACGGAGAGTACAGAAAGACAAGAGAAAGGGATTC
ATTGGGATTACCGACTACGAAAAGTGGGCTTTGAGCCCGTGTCATTCAGTCACGACGTGGTGGATGAC
GTTCAAGCTCTACTCAAGAGATACAAGAAGGGGTGGGGTCTTGACATCACCGATGCCAGGCTTTACCT
TACCTGGAAGGAACAAGCAGTTATTTGCAGCACCACATGGAAG
```

SEQ ID NO: 215, protein - Physcomitrella patens
```
WAKALLLDCARAIAEKDTSRVQSIMWILNESASPYGDSDQRLMSYFVQALVCKITDTGSRCHRSLTSA
AEKTYSFESMRNMILNFQQNASPWTTFGHVAANGALLETMEGESKIHIIDISSTLCTQWPTFLEALAT
RTDITPHLRLTCIVISPEEAALRVMKQVMNRIDRFARLMGVPFESTVIHKPHLETLDLDELNLREGEA
```

FIGURE 17 (continued)

LAVNCVQTLHHISECVAAEEQYSPRDRILSTFRSAKPKILSIVEDEANMISPDFLGCFREALRFYSLL
FESLEESFPRASNERLMLERNCARKLVNMLSFDATESTERQEKGIHWDYRLRKVGFEPVSFSHDVVDD
VQALLKRYKKGWGLDITDARLYLTWKEQAVICSTTWK

SEQ ID NO: 216, DNA - Physcomitrella patens
CTACTGGTAGAATGTGCGAGGGCAATCACTGCAAATGATTCCGCTCGTGTGAAGAACTTGATGTGGGT
GTTGAATGAGCTGGGCTCTCCGTACGGAGACGCTGACCAAAGAGTAGCTGCATATTTCCTGCAGGCTT
TGTTTTGTAAGATCACCAATACGGGATCTAGCTGCTACCGCGCACTCACTGCTGCTGCGGAGAGGACC
TATTCGTTCGATACATTACGAAAAATGATTCTCGACTACCAGGAGGCAAGTCCGTGGACAACTTTCGG
TCATACAGCTGGAAACGGAGCTATGATGGAGGCCTTTGAAGGTGAGACAAAAATTCACATTGTGGACA
TGAGCAGCACCTATTGCACCCAATGGCCGATCCTTTTCGAAGCTCTAGCAACACGAGCTGAGGGTACA
CCTCACCTACGCCTGAGCACCATCGTCATATCCCCCGAGGAGTCTGCCTTACAGGTGATGAAGCAGAT
TATGACCAGGTTGGAAAGATTTGCTAGACTTATGGGTGTTCCATTTGAGTACGTTGTAAAGCATGAAC
CACAACTGGAGAAATTGGAACTTGCAGCGCTGGACCTGCGGCAGGACGAAGTCCTCGCCATCACGTGC
AATCACACTCTTCATCACGTGTCGGAGATTGTGCCACGAGGAGAGCAGTACAGTCCGCGCGATGTGCT
CCTGTGCACCTTCCGAAACGCAAATCCGAAGATTATGATCCTTGTGGAGGAAGAAGTGGATCTGACTT
CGCCAGATTTTATTGTTTGTTTCTGTGAGGCGCTCAAGTTTTATTCCCTCTTGTTTGAATCCCTGGAG
GAGAACTTCCCCAGAACTAGCAACGAACGTTTAATCCTGGAGCGGATTTGTGCACGGAACCTGGTCAA
TCTGATAGGTTGTGACCCTCCAGAGAACGTTGAGAGGCAGGAGACGGGAATCCAGTGGGATCTCCGTT
TGAAAAGAATAGGCTTCGTGCCCTGCCCCTTCAGCGACGATGTTGTTGACGACGTTCGTGCGCTCCTC
AAGAGGTACAAAGAGGGATGGAGCCTGAGCATGAACGAGAACAGACTTTACCTAGCGTGGAAAGAGCA
GGTGGTTCTATGCGCCACTGCTTGGAAG

SEQ ID NO: 217, protein - Physcomitrella patens
LLVECARAITANDSARVKNLMWVLNELGSPYGDADQRVAAYFLQALFCKITNTGSSCYRALTAAAERT
YSFDTLRKMILDYQEASPWTTFGHTAGNGAMMEAFEGETKIHIVDMSSTYCTQWPILFEALATRAEGT
PHLRLSTIVISPEESALQVMKQIMTRLERFARLMGVPFEYVVKHEPQLEKLELAALDLRQDEVLAITC
NHTLHHVSEIVPRGEQYSPRDVLLCTFRNANPKIMILVEEEVDLTSPDFIVCFCEALKFYSLLFESLE
ENFPRTSNERLILERICARNLVNLIGCDPPENVERQETGIQWDLRLKRIGFVPCPFSDDVVDDVRALL
KRYKEGWSLSMNENRLYLAWKEQVVLCATAWK

SEQ ID NO: 218, DNA - Oryza sativa
ATGGATACCCTCTTCAGGTTGGTTAGCCTCCACCACCATCACCACCACCAGCACGCGGCCTCACCGTC
GCCGCCGGACCAGCCGCACAAGTCGTACCCCTCCTCGCGAGGGAGCACCAGCTCCCCCTCCTCCCACC
ACACCCACAACCACACCTACTACCACCACTCCCACTCCCACTACAACAATAATAGCAACACCAACTAC
TATTACCAGGGTGGTGGAGGCGGCGGCGGAGGGTACTACTACGCGGAGGAGCAGCAGCCGGCGGCGTA
CCTAGAAGAATGCGGCAACGGCCACCAGTTTTACATGGATGAAGACTTCTCCTCCTCGTCTTCCTCCC
GCCAGTTCCACTCGGGAACGGGCGCGCCGTCGTCGGCGCCGGTGCCTCCTCCTCCGTCGGCGACGACG
TCGTCCGCGGGCGGGCACGGGCTGTTTGAGGCGGCGGACTTCTCGTTCCCGCAGGTTGATATCAGCCT
CGACTTCGGCGGCTCTCCGGCCGTTCCGTCGTCGTCCGGTGCTGGCGCCGGCGCCGGGGCAGCGCCGT
CGTCGTCGGGGAGGTGGGCGGCGCAGCTGCTGATGGAGTGCGCGCGCGCGGTGGCGGGGCGCGACAGC
CAGCGCGTGCAGCAGCTCATGTGGATGCTCAACGAGCTGGCCTCGCCGTACGGCGACGTCGACCAGAA
GCTGGCCTCCTACTTCCTGCAGGGCCTCTTCGCGCGGCTCACCACCTCCGGCCCGCGCACGCTGCGGA
CGCTCGCCACCGCGTCGGACCGGAACGCGTCGTTCGACTCCACGCGCCGACGGCGCTCAAGTTCCAG

FIGURE 17 (continued)

```
GAGCTCAGCCCGTGGACGCCGTTCGGGCACGTCGCCGCCAACGGCGCCATACTCGAGTCGTTCCTGGA
GGCCGCGGCGGCGGGCGCCGCCGCCTCCTCCTCCTCGTCGTCTTCATCGTCGACGCCGCCGACGCGGC
TGCACATCCTCGACCTGAGCAACACGTTCTGCACGCAGTGGCCGACCCTCCTGGAGGCGCTGGCCACC
CGGTCCTCGGACGACACGCCGCACCTGTCCATCACCACCGTCGTGCCCACGGCGGCGCCGTCGGCGGC
CGCGCAGCGCGTGATGCGGGAGATCGGGCAGCGCCTCGAGAAGTTCGCGCGGCTGATGGGCGTCCCGT
TCAGCTTCCGCGCCGTGCACCACTCGGGGGACCTGGCCGACCTCGACCTCGCCGCGCTGGACCTCCGC
GAGGGCGGCGCCACCGCCGCGCTCGCCGTCAACTGCGTAAACGCGCTGCGCGGGTCGCGCGGGGGCG
CGACGCGTTCGTGGCGTCGCTCCGGCGCCTGGAGCCGCGCGTGGTCACCGTCGTGGAGGAGGAGGCCG
ACCTGGCGGCGCCGGAGGCGGACGCGTCGTCGGAGGCCGACACCGACGCCGCGTTCGTCAAGGTGTTC
GGCGAGGGCCTCCGCTTCTTCTCGGCGTACATGGACTCGCTGGAGGAGAGCTTCCCCAAGACAAGCAA
CGAGAGGCTGTCACTGGAGAGGGCGGTCGGCCGTGCCATCGTCGACCTCGTGTCATGCCCGGCCTCCC
AGTCCGCCGAGCGCCGGGAGACCGCCGCGTCGTGGGCGCGGCGCATGCGGTCGGCGGGGTTCTCGCCG
GCGGCATTCAGCGAGGACGTCGCCGACGACGTGCGGTCGCTTCTCCGGCGGTACAAGGAGGGCTGGTC
GATGCGGGACGCCGGCGGTGCCACGGACGACGCCGCCGGCGCCGCTGCTGCCGGAGCGTTCCTTGCGT
GGAAGGAGCAGCCTGTCGTGTGGGCGAGCGCGTGGAAGCCATGA
```

SEQ ID NO: 219, protein - Oryza sativa
```
MDTLFRLVSLHHHHHHQHAASPSPPDQPHKSYPSSRGSTSSPSSHHTHNHTYYHHSHSHYNNNSNTNY
YYQGGGGGGGGYYYAEEQQPAAYLEECGNGHQFYMDEDFSSSSSSRQFHSGTGAPSSAPVPPPPSATT
SSAGGHGLFEAADFSFPQVDISLDFGGSPAVPSSSGAGAGAGAAPSSSGRWAAQLLMECARAVAGRDS
QRVQQLMWMLNELASPYGDVDQKLASYFLQGLFARLTTSGPRTLRTLATASDRNASFDSTRRTALKFQ
ELSPWTPFGHVAANGAILESFLEAAAAGAAASSSSSSSSSTPPTRLHILDLSNTFCTQWPTLLEALAT
RSSDDTPHLSITTVVPTAAPSAAAQRVMREIGQRLEKFARLMGVPFSFRAVHHSGDLADLDLAALDLR
EGGATAALAVNCVNALRGVARGRDAFVASLRRLEPRVVTVVEEEADLAAPEADASSEADTDAAFVKVF
GEGLRFFSAYMDSLEESFPKTSNERLSLERAVGRAIVDLVSCPASQSAERRETAASWARRMRSAGFSP
AAFSEDVADDVRSLLRRYKEGWSMRDAGGATDDAAGAAAAGAFLAWKEQPVVWASAWKP
```

SEQ ID NO: 220, DNA - Oryza sativa
```
ATGGATACGCTGTTTAGGTTGGTTAGCCTCCAAGCCGCCTCCGAGCAGCAGCAGCAGCAGCAGCAGTC
GGCGTCCTACAACTCGAGGAGCACGACGTCGAGCGGGTCCAGGTCGTCGTCGCACCAGACGAACGCGT
CCTACAGCTACTACCACCACAGCAGCAACAGCGGCGGCGGCGGCGGAGGCGGCGGAGGGTACTACTAC
GGCGGCCAGCAGCCGCCGCCGTCGCAGTACTACTACCTGGAGCCGTACCAAGAAGAATGCGGCAACGC
CCCACACCACCAGCTTTACATGGATGAAGACTTCTCCTCCTCGTCGTCGTCGAGGCACTTCCACCACG
GCGCGCGGGTGCAGCAGCAGCAGCCGCCGGCGTCGTCCACGCCCACGGGGACGGCGCCGACGCCGCCG
CTGTCGACCTCGTCCACCGCGGCGGCGCCGGGCACGGCCTGTTCGAGGCGGCGGACCTGTCGTTCCCC
GCCGGACCTCAACCTCGACTTCTCGTCCCCGGCGTCGTCGTCCGGCGGCGGGACAGCGTCGTCGGGCG
CGGTTGGGGCGGCGGCGGCGGAGGTGGGCTAGCCAGCTGCTGCTGGAGTGCGCGCGGTCGGTGGCC
GCCCGCGACAGCCAGCGCGTGCAGCAGCTCATGTGGATGCTCAACGAGCTCGCGTCGCCGTACGGCGA
CGTGGAGCAGAAGCTGGCTTCCTACTTCTTGCAGGGGCTGTTCGCTCGGCTCACGGCGTCCGGGCCGC
GCACGCTGCGCACGCTCGCCGCGGCGTCCGACCGGAACACGTCGTTCGACTCGACGCGGCGCACGGCG
CTGCGGTTCCAGGAGCTCAGCCCCTGGTCCTCGTTTGGGCACGTCGCCGCCAATGGCGCCATCCTCGA
GTCCTTCCTGGAGGTCGCCGCCGCGGCGTCGTCGGAGACGCAGCGGTTCCACATCCTCGACCTGAGCA
ACACGTTCTGCACGCAGTGGCCGACGCTGCTGGAGGCGCTGGCCACGCGGTCCGCCGACGAGACGCCG
CACCTCTCGATCACCACCGTGGTGTCCGCCGCGCCGTCCGCGCCCACGGCGGCGGTGCAGCGCGTCAT
```

FIGURE 17 (continued)

```
GCGGGAGATCGGGCAGCGCATGGAGAAGTTCGCGCGGCTCATGGGCGTGCCCTTCCGCTTCCGCGCCG
TGCACCACTCCGGGGACCTCGCGGAGCTCGACCTCGACGCGCTCGACCTCCGCGAGGGCGGCGCCACC
ACCGCGCTCGCCGTCAACTGCGTCAACTCGCTGCGCGGCGTGGTTCCCGGCAGGGCCCGCCGGCGCGA
CGCGTTCGCGGCGTCGCTCCGCCGGCTGGACCCGCGGGTCGTCACCGTCGTCGAGGAGGAGGCGGACC
TGGTGGCGTCCGATCCCGACGCGTCGTCGGCGACGGAGGAAGGCGGCGACACGGAGGCGGCGTTCCTC
AAGGTGTTCGGCGAGGGCTTGCGCTTCTTCTCGGCGTACATGGATTCGCTCGAGGAGAGCTTCCCCAA
GACGAGCAACGAGAGGCTGGCATTGGAGAGGGGAGCAGGGCGCGCCATCGTCGACTTGGTCTCGTGCC
CGGCGTCGGAGTCGATGGAGCGGCGGGAGACGGCGGCGTCGTGGGCGCGGCGCATGCGGTCGGCCGGG
TTCTCTCCGGTGGCATTCAGCGAGGACGTCGCCGACGACGTGCGATCGCTGCTGCGCCGGTACAGGGA
AGGGTGGTCGATGCGCGAGGCCGGCACGGACGACTCGGCGGCCGGAGCCGGCGTCTTCCTCGCGTGGA
AGGAGCAGCCTCTGGTGTGGGCAAGCGCGTGGCGGCCATGA
```

SEQ ID NO: 221, protein - Oryza sativa
```
MDTLFRLVSLQAASEQQQQQQQSASYNSRSTTSSGSRSSSHQTNASYSYYHHSSNSGGGGGGGGYYY
GGQQPPPSQYYYLEPYQEECGNAPHHQLYMDEDFSSSSSSRHFHHGARVQQQQPPASSTPTGTAPTPP
LSTSSTAAGAGHGLFEAADLSFPPDLNLDFSSPASSSGGGTASSGAVGGGGGGRWASQLLLECARSVA
ARDSQRVQQLMWMLNELASPYGDVEQKLASYFLQGLFARLTASGPRTLRTLAAASDRNTSFDSTRRTA
LRFQELSPWSSFGHVAANGAILESFLEVAAASSETQRFHILDLSNTFCTQWPTLLEALATRSADETP
HLSITTVVSAAPSAPTAAVQRVMREIGQRMEKFARLMGVPFRFRAVHHSGDLAELDLDALDLREGGAT
TALAVNCVNSLRGVVPGRARRRDAFAASLRRLDPRVVTVVEEEADLVASDPDASSATEEGGDTEAAFL
KVFGEGLRFFSAYMDSLEESFPKTSNERLALERGAGRAIVDLVSCPASESMERRETAASWARRMRSAG
FSPVAFSEDVADDVRSLLRRYREGWSMREAGTDDSAAGAGVFLAWKEQPLVWASAWRP
```

SEQ ID NO: 222, DNA - Zea mays
```
ATGGATACGCTGTTTAGGTTGGTTAGCCTTCAAGCCTCCGAACAGCAGCAGCAGCAGCAATCGGCGTC
CTACAACTCGAGGAGCACCACGTCGAGCGGCTCCAGGTCGTCGTCGCACCAGACCAACGCATCCTACA
ACTACTACTACCACAGCAACAGCAGCGGCGGCGGCGGCGGCGGGCAGTACTACTACGGTCAGCAGCAC
CCACAGCAGCACCAGCACCAGCAGTACTACCTGGAGCCGTACCAGCAAGAAGAATGCGGCAACACCCA
CCACCTTTACATGGATGAAGACTTCTCCTCCTCGTCCTCGTCGAGGCAGCATTTCCACTCGCACGGCG
CGGTGGTGCAGCCGCCGACGTCGTCCACGGCCACGCCCACGGCGCCGACGCCCTCGCTGTCCACGTCG
TCCACGGCCGCTGGGCGGCGCACGCGCTGTTCGAGGCGGCCGACCTGTCGTTCCCGCCTGACCTCAA
CCTCGACTTCTCATCCCCGGCCTCGTCGTCCGGCGGGGCGCGGCCTCGTCGGCGGCGGTCGGGGGAG
GTGGCGGGGGAAGGTGGGCGAGCCAGCTGCTGCTGGAGTGCGCGCGCGCGGTGGCGGGCCGCGACAGC
CAGCGCGTGCAGCAGCTGATGTGGATGCTCAACGAGCTGGCCTCGCCGTACGGGGACGTCGAGCAGAA
GCTGGCGTCCTACTTCCTCCAGGGGCTCTTCGCGCGCCTCACGGCGTCCGGACCGCGGACGCTGCGCA
CGCTCGCGGCGGCGTCCGACCGGAACACGTCCTTCGACTCCACGCGGCGCACGGCGCTGCGGTTCCAG
GAGCTCAGCCCGTGGTCGTCGTTTGGGCACGTGGCCGCCAACGGCGCCATCCTGGAGTCGTTCCTGGA
GGCCGCCGCGGCGTCGCCGGAGCCCCAGAGGCTCCACATCCTCGACCTCAGCAACACGTTCTGCACGC
AGTGGCCCACGCTGCTGGAGGCGCTCGCCACGCGGTCCGCCGACGACACGCCGCACCTGTCGATCACC
ACGGTGGTCTCCTCCGCGCCGTCCGCGCCGACGGCCGCCGTGCAGCGCGTGATGCGGGAGATCGGGCA
GCGGATGGAAAAGTTCGCGCGGCTGATGGGCGTGCCCTTCAGCTTCCGCGCAGTGCACCACGCCGGGG
ACCTTGCGGGGCTCGACCTCGACGCGCTCGACCTGCGCGACGGCGGCGCCACCACCGCGCTCGCCATC
AACTGCGTCAACTCGCTGCGCGGCGTGGTGCCGGGCGGTGCGCGGAGACGGGACGCGTTCGCCGCGTC
CCTCCGGCGTCTCGATCCGCGGGTTGTTACTGTCGTCGAGGAGGAGGCCGATCTCGTGGCTTTTGACC
```

```
CCGGCGCGCCCGAGGAAAGCGGCGACACGGAGGCAGCGTTCCTGAAGGTGTTCGGCGAGGGCTTGCGG
TTCTTCTCGGCTTACATGGACTCGCTGGAAGAGAGCTTCCCCAAGACTAGCAACGAGAGGCTGGCGCT
GGAGAGGGGAGCCGGACGTGCCATTGTAGACTTGGTCTCGTGCCCGGCGTCGGAGTCCATGGAGCGGC
GGGAGACGGCGGCTTCATGGGCGCGCCGCATGCGGTCTTCCGGCTTCTCTCCGGTGGCGTTCAGCGAG
GACGTCGCCGACGACGTGCGGTCGTTGCTCCGTCGGTATCGGGAAGGCTGGTCGATGCGGGACGCCGG
TTTAGACGACTCGGCAGCCGGAGCAGGCGTCTTCCTGGCGTGGAAGGAACAGCCTCTCGTGTGGGCGA
GCGCGTGGAGGCCATGA
```

SEQ ID NO: 223, protein - Zea mays
```
MDTLFRLVSLQASEQQQQQQSASYNSRSTTSSGSRSSSHQTNASYNYYYHSNSSGGGGGGQYYYGQQH
PQQHQHQQYYLEPYQQEECGNTHHLYMDEDFSSSSSSRQHFHSHGAVVQPPTSSTATPTAPTPSLSTS
STAAGAAHALFEAADLSFPPDLNLDFSSPASSSGGGAASSAAVGGGGGGRWASQLLLECARAVAGRDS
QRVQQLMWMLNELASPYGDVEQKLASYFLQGLFARLTASGPRTLRTLAAASDRNTSFDSTRRTALRFQ
ELSPWSSFGHVAANGAILESFLEAAAASPEPQRLHILDLSNTFCTQWPTLLEALATRSADDTPHLSIT
TVVSSAPSAPTAAVQRVMREIGQRMEKFARLMGVPFSFRAVHHAGDLAGLDLDALDLRDGGATTALAI
NCVNSLRGVVPGGARRRDAFAASLRRLDPRVVTVVEEEADLVAFDPGAPEESGDTEAAFLKVFGEGLR
FFSAYMDSLEESFPKTSNERLALERGAGRAIVDLVSCPASESMERRETAASWARRMRSSGFSPVAFSE
DVADDVRSLLRRYREGWSMRDAGLDDSAAGAGVFLAWKEQPLVWASAWRP
```

SEQ ID NO: 224, DNA - Lactuca sativa
```
ATGGATACTATGTCCACCCTCCGACACCAACAACTCCTCTCTGATTATCAACAACAACATCATCATCA
TCATCATCGTCAATCTTTCAACTCCACCGTAAGTTCTAGCAGTCCTAGATCCTCCACCGATCATCAAA
CAACCACCGGCGCCGGCCATTACTACCAACCACAAGAAGAATGTTTCCCTAGTACTTTCTTCATGGAA
GAAGATGATCTCTCTTCTTCTTCCTCATTGCAACAACACTACTACTCTTCTAACCAGTTACAACCCCA
TTTCCACCACCAGTTTTCCGCCACTCCTACTCCTACTTCCACCACAAGCACCACCACCACTCCTCCTC
CACCTCCCAAGACTCATGGTTTTCTTCTAATTCTGATCATACCAACTTTAACTACTCGTCTTCCCAG
GATCATATCGCTATGGAGTTTTCGAATTCGTTCTCCGCCAACGGCTGGGCGTCGGATGTGTTATTGGA
GGCTGCGCGTGCGGTGGCTGATAAGAACAGCACGCGTCTACAGCAGTTGATGTGGATGCTCAACGAGC
TCAGTTCTCCCTATGGCGATGTAGATGAGAAGCTTTCTTGTTACTTTCTTCAAGCGCTTTACAGTCGG
ATGACGGATTCCGGTGAGTTGAATTACCGGAATTTATCGTCGATTTCGGAGAAAGTTAGCACCTTTGA
ATCAACCAGAGAATTGGTGCTCAAGTTTCAAGAAGTCAGCCCATGGACGACGTTCGGACACGTTGCGT
GTAACGGAGCGATCTTAGAGGCGTTAGACGGCGAGACTAAATTGCACATTGTTGATGTCAGCAACACA
TACTGCACACAGTGGCCGACGTTGCTGGAAGCCATCGCCACCCGGGCAGATGAAGCACCACATCTCCG
CCTCACGACGGTGATCTCCTCCAGATCAGCCGGCAGCGACGGAATAGAGAGGATCATGCGAGAAATAG
GGAGTCGGATGGAAAAATTCGCCAGGTTAATGGGTGTCCCGTTTAAATTCAATGTGATACACCATATC
GGCGATTTATCCGATCTGAATTTTAGTCAGTTAGCTATTCAATCTGATGAAGCTCTTGCTATAAACTT
AAATGGCACGTTACGTTCTGTTAGTAATCACCGTAGGGATTATTTGATCTCGATGTTTCGGAGTATGA
ACCCTAAAATAATGACGATCGTGGAAGAAGAAGCTGATTTGGAAGTGGGGATTGATGGGTTTGAATTC
TTGAGAGGATTTCAAGAGTGTTTGAAATGGTTTAGGGTTTACTTCGAAGCTCTCAACGAAAGCTTTCC
TCAAACGAGTACCGAGAGATTGATGTTGGAGAGGGAGGCGGGGCGGGCTGTGATGGACTTGGTGGCAT
GCTCGCCGGCGAATTCCGTGGAGAGGCGGGAGACGGCTAACCGGTGGTCCAGTAGACTTCGTGCAAAT
GGTTTTGGTGGGGTTTCATATAGCGAAGAAGGGTGCGACGATGTCCGGGCACTGCTGAGGAGGTATAA
GGAAGGGTGGTCAATGGCTCCGTCGGAAACGGCGGCCGGAATTTTTTTTGATGCGTAA
```

FIGURE 17 (continued)

SEQ ID NO: 225, protein - Lactuca sativa
MDTMSTLRHQQLLSDYQQQHHHHHRQSFNSTVSSSSPRSSTDHQTTTGAGHYYQPQEECFPSTFFME
EDDLSSSSSLQQHYYSSNQLQPHFHHQFSATPTPTSTTSTTTTPPPPPKTHGFSSNSDHTNFNYSSSQ
DHIAMEFSNSFSANGWASDVLLEAARAVADKNSTRLQQLMWMLNELSSPYGDVDEKLSCYFLQALYSR
MTDSGELNYRNLSSISEKVSTFESTRELVLKFQEVSPWTTFGHVACNGAILEALDGETKLHIVDVSNT
YCTQWPTLLEAIATRADEAPHLRLTTVISSRSAGSDGIERIMREIGSRMEKFARLMGVPFKFNVIHHI
GDLSDLNFSQLAIQSDEALAINLNGTLRSVSNHRRDYLISMFRSMNPKIMTIVEEEADLEVGIDGFEF
LRGFQECLKWFRVYFEALNESFPQTSTERLMLEREAGRAVMDLVACSPANSVERRETANRWSSRLRAN
GFGGVSYSEEGCDDVRALLRRYKEGWSMAPSETAAGIFFDA

SEQ ID NO: 226, DNA - Medicago truncatula
ATGGATACGCTGTTTAGGCTTGTCAATTTTCAACAACAACAACAACAATATCAACCTGATCCTTCCCT
CAACTCCACCACCACCTTAACAACTTCTAGCAGCTCTAGATCCTCAAGACAAACAACATATCATTATT
ACAACCAACAAGAAGAAGACGAAGAATGCTTCAACAACTTTTATTACATGGATCATAATAACAACAAT
GATGAAGATTTATCCTCATCTTCTTCTAAACAACACTATTATACTTATCCTTATGCTTCCACTACTAC
TATCACTACTCCAAACACTACTTATAATACTATCAACACCCCCACCACAACTGATAATTACTCTTTCT
CACCCTCCCATGATTACTTCAACTTTGAATTCTCCGGTCACTCTTGGTCACAAAACATCCTCCTTGAA
ACTGCACGTGCATTTTCCGACAATAACACAAACCGAATCCAACAACTCATGTGGATGCTAAACGAGCT
TAGTACCCCATATGGTGACACAGATCAAAAACTTTCATCTTATTTTCTTCAAGCTTTGTTTAGTCGCA
TGAACGACGCGGGAGATAGAACCTACAAAACCTTAACAACCGCGTCGGAAAAAACATGTTCCTTTGAT
TCAACGAGGAAGATGTTGTTGAAGTTCCAAGAAGTTAGTCCATGGACAACGTTTGGACACGTGGCAGC
TAACGGTGCTATCTTAGAAGCATTGGAAGGTAACCCTAAACTTCACATAATTGATATTAGCAACACTT
ATTGCACTCAATGGCCAACACTCCTCGAAGCGTTGGCCACCCGCTCTGATGATACGCCTCACCTTCGT
TTAACCACTGTAGTCACTGCAATCAGCGGTGGCTCGGTGCAAAAAGTCATGAAGGAAATTGGTTCAAG
GATGGAAAAATTTGCTAGGCTTATGGGAGTGCCGTTTAAATTCAAAATCATTTTCAGTGATTTAAGAG
AGTTGAATTTGTGTGATTTAGATATTAAAGAAGATGAAGCTTTGGCTATAAACTGTGTAAACTCTTTA
CATTCGATATCCGGAGCCGGAAACCACCGTGATTTGTTTATATCTTTGCTTCGTGGGTTAGAACCTAG
GGTTTTAACTATTGTTGAAGAAGAAGCTGATTTAGAAGTTTGTTTTGGTTCGGATTTCGTGGAAGGTT
TTAAAGAGTGTTTAAGATGGTTTAGGGTTTATTTTGAAGCACTTGATGAAAGTTTTTCAAGAACAAGT
AGTGAGAGGTTGATGCTAGAAAGAGAAGCTGGGAGAGGTATTGTTGATTTGGTTGCTTGTGATCCTTA
TGAGTCAGTGGAGAGACGTGAAACGGCGGCGCGGTGGAGGAGGAGGTTGCATGGTGGCGGGTTTAATA
CGGTGTCGTTTAGTGATGAAGTTTGTGATGATGTTAGGGCTTTATTGAGAAGGTATAAAGAAGGGTGG
TCGATGACATCCTCCGATGGTGATACCGGAATATTCTTGTCGTGGAAGGATAAGCCGGTGGTGTGGGC
CAGTGTATGGAGGCCTTGA

SEQ ID NO: 227, protein - Medicago truncatula
MDTLFRLVNFQQQQQQYQPDPSLNSTTTLTTSSSSRSSRQTTYHYYNQQEEDEECFNNFYYMDHNNNN
DEDLSSSSSKQHYYTYPYASTTTITTPNTTYNTINTPTTTDNYSFSPSHDYFNFEFSGHSWSQNILLE
TARAFSDNNTNRIQQLMWMLNELSTPYGDTDQKLSSYFLQALFSRMNDAGDRTYKTLTTASEKTCSFD
STRKMLLKFQEVSPWTTFGHVAANGAILEALEGNPKLHIIDISNTYCTQWPTLLEALATRSDDTPHLR
LTTVVTAISGGSVQKVMKEIGSRMEKFARLMGVPFKFKIIFSDLRELNLCDLDIKEDEALAINCVNSL
HSISGAGNHRDLFISLLRGLEPRVLTIVEEEADLEVCFGSDFVEGFKECLRWFRVYFEALDESFSRTS
SERLMLEREAGRGIVDLVACDPYESVERRETAARWRRRLHGGGFNTVSFSDEVCDDVRALLRRYKEGW
SMTSSDGDTGIFLSWKDKPVVWASVWRP

FIGURE 17 (continued)

SEQ ID NO: 228, DNA - Solanum tuberosum
ATGGATACTTTGTTTAGATTAGTTACCCTTCAACAACAACAACAACAACAACAATCTGATCAATATTC
TTTTAACTCCAGCAGAACTTCAAGCAGCTCTAGATCTTCTAACAAACAAAACACATATAATTATCATC
CACATCATAATAATCAAGACGAAGAATGCTTCAACTTTTTCATGGATGAAGATGATTTCTCTTCTTCT
TCTTCTAAACACAACAACAACTATCCTCCTCCTCATTACAATCAATATCATCAACAAATTTCCAACAC
TCCCACACCGACAACTACAAGCAGTACCCCGACACAACAATCTCAATCTCATCACTATGATCATCAAT
TCTCCCCAGCACGTGATTTAAATCTCGAATTCGCTTCCTCATTTTCCGGAAAATGGGCGACGGACATT
CTTCTAGAAACTTCTCGTGCCATTGCCGATAAGAACAGTACACGTGTCCAACAACTCATGTGGATGTT
GAATGAGTTGAGTTCTCCATATGGAGATACCGAACAAAAATTGGCTTCTTATTTTCTTCAAGCATTAT
TTAGCCGTATGACGGATTCTGGCGAACGATGTTATCGTACGTTGTTATCCGCTTCGGATAAAACATGT
TCGTTCGAGTCAACGAGGAAATTAGTTTTGAAATTTCAGGAAGTTAGCCCTTGGACGACTTTTGGTCA
CGTTGCATCCAATGGTGCAATTATGGAAGCCTTAGAAGGTGAGTCAAAGTTGCATATAATTGATATTA
GCAACACTTATTGTACTCAATGGCCTACTTTACTAGAAGCGCTAGCAACCCGCACCGATGAAACACCG
CATCTCCGCCTCACCACGGTGGTTGCCGCTAGCGGAGGTGCAGCGTCCGTGCAAAAAGTGATGAAGGA
GATTGGTAATAGAATGGAAAAATTCGCTAGGCTTATGGGCGTACCGTTTAAATTCAACGTCATTCACC
ATGCGGGAAATTTATCTGAGTTGGATATTGGTGCCTTAGATATTAAAGGAGATGAAGCGCTAGCAATT
AATTGTATTGGTGCGTTACATTCCGTTACGCCAGCTGGCAATCGAAGGGATTATTTGATATCATTATT
TAGGAGGTTACAACCTAGGATTGTTACAATTGTTGAAGAAGAAGCTGATCTTGATGTTGGTGTTGATG
GTTTCGATTTTGTTAAAGGTTTTCAAGAATGTTTGAAATGGCTTAGGGTTTATTTTGAATCATTAGAC
GAGAGTTTTTCGAAAACAAGTAACGAACGTTTGATGCTAGAGCGACAAGCAGGACGTTCGATTGTTGA
TTTACTAGCATGCCCACCATCGGAGTCAATGGAGAGGCGGGAAACGGGGCAAAATGGTCACATCGTA
TGCATGCAGGAGGGTTCAGTCAGCTTTTATATAGTGATGAAGTTTGTGATGATGTTAGAGCTTTGTTG
AGAAGGTATAAAGATGGGTGGTCGATGGGACAGTGTGGGGGAGATTCCGCCGGAATATTCTTGTCGTG
GAAGGAACAGCCGGTGGTGTGGGCCAGTGCATGGAAGCCTTAA

SEQ ID NO: 229, protein - Solanum tuberosum
MDTLFRLVTLQQQQQQQQSDQYSFNSSRTSSSSRSSNKQNTYNYHPHHNNQDEECFNFFMDEDDFSSS
SSKHNNNYPPPHYNQYHQQISNTPTPTTTSSTPTQQSQSHHYDHQFSPARDLNLEFASSFSGKWATDI
LLETSRAIADKNSTRVQQLMWMLNELSSPYGDTEQKLASYFLQALFSRMTDSGERCYRTLLSASDKTC
SFESTRKLVLKFQEVSPWTTFGHVASNGAIMEALEGESKLHIIDISNTYCTQWPTLLEALATRTDETP
HLRLTTVVAASGGAASVQKVMKEIGNRMEKFARLMGVPFKFNVIHHAGNLSELDIGALDIKGDEALAI
NCIGALHSVTPAGNRRDYLISLFRRLQPRIVTIVEEEADLDVGVDGFDFVKGFQECLKWLRVYFESLD
ESFSKTSNERLMLERQAGRSIVDLLACPPSESMERRETGAKWSHRMHAGGFSQLLYSDEVCDDVRALL
RRYKDGWSMGQCGGDSAGIFLSWKEQPVVWASAWKP

SEQ ID NO: 230, DNA - Eucalyptus grandis
ATGGATACCTTGTTTAGACTAGTGAGCCTTCAATCCTCCGATCAGTCCTTCAACTCAAGCAGGACCTC
AAGCAGCTCCAGATCCTCCCGACAAAACCATCACTACCATCACCAGCCAGAAGCGGACGAAGAATGCC
TCAACATCTTCATGGATGAAGAAGACTTCTCCTCGTCTTCTTCCAAGCACTACAGTTATCCTTATCAC
CCCGCCACCACCAGCACCACCCCTACCACCACTAGTAGTACTCACACTCCCACACTTATGACCCTGC
CGATGTATCCGTCTCGCCCGCCCGCGACCTCAACTTCGACTTCTCTAGCAAGTGGGCCTCTGACATCC
TCCTCGAGACGGCCCGTGCCATCGTCGACAAGAACAGCACCCGTGTCCAGCACCTTATGTGGATGCTC
AATGAGCTCTGCTCCCCTTATGGCGACATCGAGCAGAAGCTGGCCTCCTACTTCCTCCAGGCCCTGTT
TAGTCGCATGACGGACTCGGGCGAGCGGAGCTACAGTGCCTGGTTGGCCGCGTCGGACAAGACCTGCT FIGURE 17 (continued)

```
CCTTCGAGTCCACCCGGAAGATGGTGCTCAAGTTCCAGGAGGTGAGCCCCTGGACCACCTTCGGGCAC
GTCGCGTGCAACGGCGCAATCATGGAGGCCCTTGAGGGGGAGAGCAAGTTGCACATAGTTGACATCAG
CAACACGTACTGCACCCAGTGGCCAACCCTGCTCGAGGCTCTGGCCACCCGGACGGATGAGACGCCAC
ACCTGCGGCTCACCACCGTGGTGGTGAGCAAGGCGAACGGCGGGGCAGAGACTAGTGGCGTCGTCGCC
GTGCAGAAGGTCATGAAAGAAATTGGGAGCCGGATGGAGAAATTTGCGAGGCTCATGGGTGTGCCCTT
CAAGTTCAGCGTCCTGTACCACAGTGGCGACCTGTCAGAGTTGAATTTGGACGAGTTGGATATCAAGG
AGGACGAGGCGCTGGCCATCAACTGCGTTGGCGCGCTGCACTCGACAACGACAGTCAGCAACCGCCGG
GACTTTGTGGTCTCATCTTTCCGAAGGTTGCAACCGAGGATAATCACGGTTGTTGAGGAGGAAGCCGA
CCTCGACGTGGGCGTGGATGGGATCGAATTTGTCAGGGGTTTCCAAGAAAGCCTGAGATATTTTAGGG
TTTACTTCGAGTCGTTGGACGAGAGCTTCCCTAGAACGAGCAACGAGCGCTTGATGCTCGAGCGAGGG
GCTGGGCGAGCGGTCATGGACCTGGTGGCATGCCCACCACACCACTCGGTGGAGAGGCGGGAGCCAGC
AAGCCGGTGGTCGAGGCGCCTGCGAGGAGGCGGGTTTAATCCTTGTTTGTTCAGCGACGAGGTATGCG
ACGACGTGCGTGCCTTGTTGAGGAGGTACAAGGAAGGGTGGTCGATGACGCCGTGCTCTGACGCCGGA
ATATTCTTGACGTGGAAGGACCAGCCGGTGGTTTGGGCTAGTGCATGGAGGGCTTGA

SEQ ID NO: 231, protein - Eucalyptus grandis
MDTLFRLVSLQSSDQSFNSSRTSSSSRSSRQNHHYHHQPEADEECLNIFMDEEDFSSSSSKHYSYPYH
PATTSTTPTTTSSTHTPHTYDPADVSVSPARDLNFDFSSKWASDILLETARAIVDKNSTRVQHLMWML
NELCSPYGDIEQKLASYFLQALFSRMTDSGERSYSAWLAASDKTCSFESTRKMVLKFQEVSPWTTFGH
VACNGAIMEALEGESKLHIVDISNTYCTQWPTLLEALATRTDETPHLRLTTVVVSKANGGAETSGVVA
VQKVMKEIGSRMEKFARLMGVPFKFSVLYHSGDLSELNLDELDIKEDEALAINCVGALHSTTTVSNRR
DFVVSSFRRLQPRIITVVEEEADLDVGVDGIEFVRGFQESLRYFRVYFESLDESFPRTSNERLMLERG
AGRAVMDLVACPPHHSVERREPASRWSRRLRGGGFNPCLFSDEVCDDVRALLRRYKEGWSMTPCSDAG
IFLTWKDQPVVWASAWRA SEQ ID NO: 232, DNA - Vitis vinifera
ATGGATACCTTGTTTAGACTAGTCAGTCTTCAATCCGATCAATCCTACAACTCCAGTAGAACTTCTAG
CAGCTCTAGATCTTCTAGACAAAACCATCACCACCACCACCAAGAAGACGAAGAATGCTTCAACTTTT
TCATGGATGAAGAAGACTTCTCTTCTTCTTCTTCCAAGCACTACTATCCTTATCAGCAACAAACCCAT
CCTTCTTCACCACCACCCCCACCACCACCAACACCACCAGCACTCCTACTCATCATGCCTTTGAGCCCNAC
CGAATTCTCTTTCTCCCCTGCCCGTGATCTCCACCTAGAATTCAACTCTTCTGCTTCCGGCAAGTGGG
CTTCCGAAATCCTCCTGGAGACAGCACGAGCCATCGCTGATAAGAACAGCGCTCGCGTTCAACAACTC
ATGTGGATGCTCAACGAGCTTAGCTCTCCTTATGGCGACACCGATCAGAAGCTCGCTGCTTACTTCCT
TCAAGCCTTGTTTAGCCGCATGACCGACTCGGGTGAGAGGTGTTACCGGACTTTAATATCCGCATCGG
AGAAGACTTGCTCATTCGAATCCACCAGAAAAATGGTATTGAAATTTCAAGAGGTGAGCCCTTGGACC
ACGTTTGGACATGTAGCTTGTAATGGTGCAATCATGGAAGCTCTTGAAGGCGAGAGCAAGCTCCATAT
AATTGATATAAGCAACACCTACTGCACTCAGTGGCCCACCTTGCTCGAAGCCCTAGCCACCCGCACTG
ACGAGACCCCTCACCTCCGTCTCACCACCGTCGTCACAAGCAAAGCCGGCACCGGAGGGATGGCACCA
GTGCAAAAACTGATGAAAGAGATTGGAAACAGAATGGAAAAGTTCGCTAGGCTCATGGGTGTGCCCTT
CAAATTCAACGTACTGCACCACTCCGGCGACCTATCCCATCTGAATTTAGCAGAATTGGACATCAAAG
ACGACGAGGCACTCGCCGTAAACTGCGTCGGCGCGTTGCACTCAGTCACCGCAGTTGGTAACCGCCGA
GACATCGTCGTATCATCTTTCCGGAGATTGCATCCGAGGATCATCACCGTCGTGGAAGAAGAAGCTGA
TCTCGATGTGGGCGTGGATGGGTTCGACTTCGTCAAAGGTTTTCAGGAATGCTTAAGATGGTTTAGGG
TTTACTTGGAGTCATTAGACGAGAGCTTCCCACGCACTAGCAACGAGCGCCTCATGCTCGAACGCGCC
```

FIGURE 17 (continued)

```
GCCGGACGMGCAATCGTCGACCTGGTGGCTTGCCCGCCGTCGGAGTCGATCGAACGGCGCGAGACGGC
CACGCGCTGGTCKCAGCGGCTCCATGCAAGCGGGTTCTCTCCGGTGTCGTTTAGCGATGAAGTATGCG
ATGACGTACGTGCTCTCCTGAGGAGATACAAGGAGGGTTGGTCAATGACACAGTCCTCCGACGCCGGA
ATATTCCTCTCATGGAAAGACCAGCCGGTGGTGTGGACCAGTGCATGGAAACCTTGA
```

SEQ ID NO: 233, protein - Vitis vinifera
```
MDTLFRLVSLQSDQSYNSSRTSSSSRSSRQNHHHHHQEDEECFNFFMDEEDFSSSSSKHYYPYQQQTH
PSSPPPPPPPTPALLLIMPLSPTEFSFSPARDLHLEFNSSASGKWASEILLETARAIADKNSARVQQL
MWMLNELSSPYGDTDQKLAAYFLQALFSRMTDSGERCYRTLISASEKTCSFESTRKMVLKFQEVSPWT
TFGHVACNGAIMEALEGESKLHIIDISNTYCTQWPTLLEALATRTDETPHLRLTTVVTSKAGTGGMAP
VQKLMKEIGNRMEKFARLMGVPFKFNVLHHSGDLSHLNLAELDIKDDEALAVNCVGALHSVTAVGNRR
DIVVSSFRRLHPRIITVVEEEADLDVGVDGFDFVKGFQECLRWFRVYLESLDESFPRTSNERLMLERA
AGRAIVDLVACPPSESIERRETATRWSQRLHASGFSPVSFSDEVCDDVRALLRRYKEGWSMTQSSDAG
IFLSWKDQPVVWTSAWKP
```

SEQ ID NO: 234, DNA - Populus trichocarpa
```
ATGGATACCTTGTTTAGGCTAGTTAGTCTCCAACAACAATCTGAACAATCTTTCAACTCTACTAGCAG
AACCTCTAGTAGCTCTAGATCATCAAGACAAAACAACAACCACCACCATCATCACTATCAACAAGAAG
ACGAAGAATGCTTCAACTTTTTCATGGATGAGGAAGACTTCTCTTCATCTTCTTCTAAGCACTACTAT
CCTCCTTATCACCACAACCAACAACAACAACATCAACACCAAACCACCACCACCACTCCTACCACTAC
TACCACCAACACTAGCACCCCTTCTACTCACCATGTCCTTGATTCCGCTGACTTCTCTTTCTCCCCTT
CTCATGACCTAAACTTTGAATTTTCCGGCAAGTGGGTCACCGATATCCTCCTTGAATCTGCACATGCC
ATCGCGGATAAAAACAGCGCTCGTCTCCAGCAATTGATGTGGATGCTTAATGAGCTTGGTTCACCTTA
TGGTGACACAGAGCAAAAACTTGCTTCTTATTTTCTCCAAGCTTTGTTTAGCCGCATGAACGACTCCG
GCGAGAGATGCTACCGTACTTTAGCTTCAGCATCAGAGAAAACTTGCTCTTTTGATTCCACAAGGAAA
ATGGTATTAAAGTTTCAAGAGGTGAGTCCTTGGACTACTTTTGGTCACGTATCTTGTAATGGCGCAAT
TATGGAAGCATTTGAAGGTGAAAGCAAATTGCATATTATTGATATTAGTAACACATATTGTACCCAAT
GGCCTACTTTGCTCGAAGCCCTAGCAACTCGCACTGATGAGACACCACACTTGAAGTTAACCACCGTA
GTGGCTAGCAAAAGTAGTGGTAATAATATTGGTTTAACTAGTACAGGAGGTTTAGCTTCAGTTCATAA
GGTAATGAAAGAAATTGGCAACAGAATGGAAAAATTTGCCAGGCTTATGGGAGTCCCATTTAAGTTTA
ATGTTATCCACCATGCTGGTGATTTATGTGACCTAAACTTAGCTGAATTGGATGTTAAAGATGATGAG
GCTCTTGCTATCAACTGTGTTGGTGCTTTACACTCAATCACTCCAGCTTCTCGTCGCCGAGATTATGT
TATATCTAGTTTTAGAACATTGCAACCAAGAATCATTACTGTTGTTGAAGAAGAAGCTGATCTTGATG
GTCTGGATTTTGTCAAGGGTTTTCAAGAATGTTTAAGATGGTTTAGGGTTTACTTTGAATCATTGGAT
GAGAGCTTTCCAAGAACCAGTAACGAACAGTTGATGCTTGAAAGAGCAGCAGGCCGCGCTATCGTTGA
CTTAGTGGCATGTCCTCCATCTGATTCGATCGAAAGGCGGGAAACAGCCACGCGCTGGTCTGGACGCC
TCCATTCATGTGGTTTTAGCCCGATAATTTTCAGTGATGAGGTTTGTGATGATGTACGCGCCTTATTG
AGGAGGTATAAGGAGGGTTGGTCAATGACACAGTGCGGGGATGCCGGAATATTCTTGTGCTGGAAGGA
ACAGCCGGTGGTGTGGGCTAGTGCATGGAGGCCCTGA
```

SEQ ID NO: 235, protein - Populus trichocarpa
```
MDTLFRLVSLQQQSEQSFNSTSRTSSSSRSSRQNNNHHHHHYQQEDEECFNFFMDEEDFSSSSSKHYY
PPYHHNQQQQHQHQTTTTTPTTTTTNTSTPSTHHVLDSADFSFSPSHDLNFEFSGKWVTDILLESAHA
IADKNSARLQQLMWMLNELGSPYGDTEQKLASYFLQALFSRMNDSGERCYRTLASASEKTCSFDSTRK
MVLKFQEVSPWTTFGHVSCNGAIMEAFEGESKLHIIDISNTYCTQWPTLLEALATRTDETPHLKLTTV
```

FIGURE 17 (continued)

VASKSSGNNIGLTSTGGLASVHKVMKEIGNRMEKFARLMGVPFKFNVIHHAGDLCDLNLAELDVKDDE
ALAINCVGALHSITPASRRRDYVISSFRTLQPRIITVVEEEADLDGLDFVKGFQECLRWFRVYFESLD
ESFPRTSNEQLMLERAAGRAIVDLVACPPSDSIERRETATRWSGRLHSCGFSPIIFSDEVCDDVRALL
RRYKEGWSMTQCGDAGIFLCWKEQPVVWASAWRP

SEQ ID NO: 236, DNA - Ricinus communis
ATGGATACGTTGTTTAGGCTAGTTAGTCTTCAACAACAGCAATCTGATCAATCTTTCAATAACTCTAC
TAGCAGAACCTCTAGCAGCTCTAGATCCTCAAGACAAAACAACCACCACCATCATCATCATCAGTACC
AACAAGAAGACGAAGAATGCTTCAACTTTTTCATGGATGAAGAAGACTTCTCTTCGTCTTCTTCTAAA
CACTACTACTATCCTTATCACCATCAACAACAGCAACAACACACCACCGCCACCACTACTACTACTGT
GACCACTCCTAACACTACCACTAGTACTCTTGAATCCACTGACCACTTCTCTTTCTCTCCTTCCCATG
ACCTAAACTTTGACTTCTCCAGCAGGTGGGCAACCGATATCCTCCTCGAAACTGCTCGTGCTATTGCT
GATAAAAACAGTGCTCGTGTTCAGCAACTCATGTGGATGCTTAATGAACTTGGCTCGCCTTATGGGGA
CATAGACAAAAAGCTTGCATCATACTTTCTACAAGCCTTGTTCAGCCGGATGACTGATTCCGGTGAGA
GATGTTACCGTACTTTAGCCTCTGCATCGGATAAAACTTGCTCTTTCGAGTCAACAAGAAAGATGGTA
TTGAAGTTTCAAGAGGTGAGTCCTTGGACTACTTTTGGTCACGTATCTTGTAATGGTGCAATAATGGA
AGCATTTGAAGGTGAAAGTAAATTGCATATTATTGATATTAGTAACACATATTGCACTCAGTGGCCAA
CGTTGCTAGAAGCCCTAGCAACTCGCACCGATGAGACACCCCACTTGAGGCTAACCACCATTGTGGCT
AGTAAAACAAATGGTGGTGGGGGCGGCGGCGGTGGCAATTGTGGTTTAGTTTCAGCCCAGAAAGTAAT
GAAAGAAATTGGAAGCAGAATGGAAAAATTTGCTAGGCTTATGGGAGTACCATTTAAATTCAATGTTA
TACACCATGCTGGTGACTTGTGTGACCTGAACTTATCTGAATTGGATATTAAAGAAGATGAAGCTTTA
GCCATCAATTGTATAGGGTCACTGCATTCAGTTACAACAGTTGCTAATCGTAGAGATTATATAATATC
AAACTTTAGAAGATTACAACCAAGAATCATCACTATTGTTGAAGAAGAAGCTGATCTTGATGTGGGTA
TTGATGGGTTAGACTTTGTAAGAGGTTTTCAAGAATGTTTAAGATGGTTTAGGGTTTACTTTGAGTCA
TTAGAAGAAAGTTTTTCAAGAACAAGCAATGAAAGATTGATGCTAGAGAGAAGTGCTGGACGTGCAAT
AGTTGACTTGGTTGCATGTCAGCCATCAGAGTCAATTGAACGGCGGGAAAAGGCGACACGGTGGTCCT
CACGGTTGCATGCATGTGGATATAGCCCTATTCTGTTTAGTGATGAGGTATGCGATGATGTACGCGCC
CTTTTGAGGAGGTATAAGGAAGGCTGGTCAATGACACAGAGCGGCCACGCCGGAATATTCCTATGCTG
GAAGGAACAGCCGGTCGTGTGGGCTAGTGCATGGAAACCTTGA

SEQ ID NO: 237, protein - Ricinus communis
MDTLFRLVSLQQQQSDQSFNNSTSRTSSSSRSSRQNNHHHHHHQYQQEDEECFNFFMDEEDFSSSSSK
HYYPYHHQQQQQHTTATTTTTTVTTPNTTTSTLESTDHFSFSPSHDLNFDFSSRWATDILLETARAIA
DKNSARVQQLMWMLNELGSPYGDIDKKLASYFLQALFSRMTDSGERCYRTLASASDKTCSFESTRKMV
LKFQEVSPWTTFGHVSCNGAIMEAFEGESKLHIIDISNTYCTQWPTLLEALATRTDETPHLRLTTIVA
SKTNGGGGGGGNCGLVSAQKVMKEIGSRMEKFARLMGVPFKFNVIHHAGDLCDLNLSELDIKEDEAL
AINCIGSLHSVTTVANRRDYIISNFRRLQPRIITIVEEEADLDVGIDGLDFVRGFQECLRWFRVYFES
LEESFSRTSNERLMLERSAGRAIVDLVACQPSESIERREKATRWSSRLHACGYSPILFSDEVCDDVRA
LLRRYKEGWSMTQSGHAGIFLCWKEQPVVWASAWKP

SEQ ID NO: 238, DNA - Glycine max
ATGGATACCTTGTTTAGACTAGTAAGTTTTCATCAACAGCAACAACCACAACAACCTGATCCATC
CCTCAACTCCACCACCAGCAGAACCTCCAGCAGCTCCAGATCCTCCAGACAAAACTACTACCCTTATT
CCCATCAAGAAGAAGAAGAATGCTTCAACTTTTACATGGATGAAGAAGACTTATCCTCGTCTTCTTCC
AAACACTACTACCACCCTTATCAACCCATCATCATCAACAACACAACGTATCCAACATTTCTACAAA FIGURE 17 (continued)

```
CACCTTCAGCACCACCCCTAACACTGATTACTCCTACTCCTACTCCTTCTCTCCCACGCAACCTGTTC
AAGACTTCAACTTCGAATTCTCCTCCCCCAACTGGTCCCACAACCTCCTCCTCGAATCCGCACGCGCC
GTCGCCGACAACAACTCCACGCGCCTCCACCACCTCCTCTGGATGCTCAACGAGCTCAGCTCCCCCTA
CGGCGACACCGAACAAAAACTTGCTGCGTATTTCCTCCGAGCCTTGTTCAGCCGCGTCACCGAAGCTG
GCGACCGAACCTACCGAAGCTTAGCTTCGGCGTCTGAGAAAACATGCTCATTTGAATCCACAAGAAAA
ACGGTCCTGAAATTCCAAGAAGTTAGCCCTTGGACTACCTTCGGACACGTGGCATCCAATGGCGCCAT
CTTGGAAGCCTTGGAGGGAAACTCCAAATTGCATATACTTGACATCAGCAACACTTATTGCACCCAGT
GGCCAATGCTTCTGGAAGCATTGGCCACTCGGAGCGAAGAAACTCCACACCTATGTTTAACAACAATT
GTTACTGGTTCTAGAATCGGTAACAACGTCCAGCGCGTGATGAAGGAAATCGGAACGCGAATGGAGAA
ATTCGCCAGACTCATGGGCGTTCCTTTTAAGTTCAACGTCGTTCATCACTACGGCGATCTATCCGAGT
TCAATTTCTCAGAGCTTGATATCAAAGACGATGAGGCTTTGGCTGTGAATTGTGTGAACTCGCTGCAT
TCGGTTTCCGCGCTAGGAAACAACCGCGACGCGTTGATATCGGCGTTGCAAGCGTTGCAGCCGCGGAT
TGTGACGGTGGTGGAGGAGGAGGCTGATTTGGACGTTGGAATCGACGGTTACGAGTTCGTAAAAGGCT
TTGAAGAAAGTTTGAGGTGGTTTAGGGTTTACTTTGAGGCTTTGGATGAGAGTTTTGTGAAGACGAGC
AACGAGAGGCTGATGCTGGAGCGCGCGGCGGGGAGGGCGGTGGTGGACCTGGTGGCGTGCTCGCCGGC
GGATTCCGTGGAGCGCCGCGAGACGGCGGCGCGGTGGGCGGCGAGGCTTCACAACGGAGGGCTAAACG
CGGCGCCGTTTAGCGACGAAGTTTGCGACGACGTGAGGGCGCTGTTGAGGAGGTACAAGGAAGGGTGG
TCGATGGCGGCGTGCTCCGACGCCGGAATATTCCTCTCGTGGAAGGACACGCCGGTGGTGTGGGCCAG
TGCATGGAGGCCATAA

SEQ ID NO: 239, protein - Glycine max
MDTLFRLVSFHQQQQPQQQPDPSLNSTTSRTSSSSRSSRQNYYPYSHQEEEECFNFYMDEEDLSSSSS
KHYYHPYQPHHHQQHNVSNISTNTFSTTPNTDYSYSYSFSPTQPVQDFNFEFSSPNWSHNLLLESARA
VADNNSTRLHHLLWMLNELSSPYGDTEQKLAAYFLRALFSRVTEAGDRTYRSLASASEKTCSFESTRK
TVLKFQEVSPWTTFGHVASNGAILEALEGNSKLHILDISNTYCTQWPMLLEALATRSEETPHLCLTTI
VTGSRIGNNVQRVMKEIGTRMEKFARLMGVPFKFNVVHHYGDLSEFNFSELDIKDDEALAVNCVNSLH
SVSALGNNRDALISALQALQPRIVTVVEEEADLDVGIDGYEFVKGFEESLRWFRVYFEALDESFVKTS
NERLMLERAAGRAVVDLVACSPADSVERRETAARWAARLHNGGLNAAPFSDEVCDDVRALLRRYKEGW
SMAACSDAGIFLSWKDTPVVWASAWRP SEQ ID NO: 240, DNA - Medicago truncatula
ATGGATACATTGTTTAGACTTGTCAGTTTTCAACCACACCAACAACAAGAAGATCAATCTCTCAACTC
CACCACCAGCAGAACAACAACATCAAGTAGCTCTCGATCCTCAAAACAAAACTATCACCAATATTACA
ATCCACAAGAAGTTGAAGAAGAATGCTTCAACTTTTTCATGGATGAAGAAGACCTTTCCTCATCTTCT
TCCAAACACTACTATCCTTATAATCAACCTCAAACCTCAAATACTATTACTACAAACACCCCCACAAC
ATCACTCACACCCCTCCACCAACAGCTGATTTCACCTTCGAATTAACCGGAAGGTGGGCCAACAACA
TCCTCCTCGAAACAGCACGAGCCATAGCAGAAAAAAACAGCACTCGTTTACAACAACTCATGTGGATG
CTTAACGAACTAAGCTCCCCTTATGGTGACATAGAACAAAAACTAGCTGCATATTTTCTCCAAGCCTT
ATTCTCTCGAATGACCGAAGCCGGTACCCGAACCTTCCGAACCCTAGCTTCAGCATCAGAAAAAACTT
GCTCTTTCGAATCAACAAGAAAACGGTTCTAAAATTCCAAGAAGTTAGTCCGTGGACAACCTTCGGC
CATGTCGCATGCAATGGCGCCATTTTAGAAGCCTTCGAAGGTGATTCCAAGCTGCACATAATTGATAT
TAGTAACACTTATTGCACTCAGTGGCCAACTCTTTTTGAAGCGTTGGCCACTCGTGCTGACGATACTC
CTCACCTCCGTCTAACTACCATCGTCACTGCTGGTGGTTCTGTTCAAAAAGTTATGAAGGAAATTGGT
GCTAGAATGGAAAAATTCGCTAGACTCATGGGAGTTCCATTTAAATTCAACGTTATTCATCACTCCGG
```

FIGURE 17 (continued)

```
CGATCTTTCTGATTTGAATTTTTTGGATTTAGATATTAAAGAAGATGAAGCTTTAGCTGTTAATTGTG
TTAATGCTTTGCATTCAGTAACAGTTGGCAATGGTAATGGTAACGGTAATAACCGTCGTGACTCGTTG
ATAGCTTCGTTGATCGCGTTGCGGCCTAGGATAGTAACAATGGTTGAAGAGGAGGCTGATTTAAATTT
TGGTAATGAAGGATATGAATTTGTGAATGGTTTTGAAGAGTGTTTAAGGTGGTTTAGGGTTTACTTTG
AAGCATTAGAAGAGAGTTTTCCGAAGACGAGTAACGAGCGTTTGATGCTTGAAAGGGAAGCAGGGAGA
GGGATAGTTGATTTGGTGGCATGTGCTCCGGCGGAGTCGATTGAACGGAGAGAAACTGCGGTGAGGTG
GTCACGGCGTTTGCATGGTCGAGGGTTTAATACGGTGGCGTTTAGTGAGGAAGTTTGTGATGATGTTA
GGGCTTTGTTGAGGAGGTATAAGGAAGGGTGGTCGATGATACGGTGTAATGATGCCGGAATATTCTTG
ACGTGGAAGGAACAACCGGTGGTGTGGGCCAGTGCATGGAGGCCTTGA
```

SEQ ID NO: 241, protein - Medicago truncatula
```
MDTLFRLVSFQPHQQQEDQSLNSTTSRTTTSSSSRSSKQNYHQYYNPQEVEEECFNFFMDEEDLSSSS
SKHYYPYNQPQTSNTITTNTPTTSLTPPPPTADFTFELTGRWANNILLETARAIAEKNSTRLQQLMWM
LNELSSPYGDIEQKLAAYFLQALFSRMTEAGTRTFRTLASASEKTCSFESTRKTVLKFQEVSPWTTFG
HVACNGAILEAFEGDSKLHIIDISNTYCTQWPTLFEALATRADDTPHLRLTTIVTAGGSVQKVMKEIG
ARMEKFARLMGVPFKFNVIHHSGDLSDLNFLDLDIKEDEALAVNCVNALHSVTVGNGNGNGNNRRDSL
IASLIALRPRIVTMVEEEADLNFGNEGYEFVNGFEECLRWFRVYFEALEESFPKTSNERLMLEREAGR
GIVDLVACAPAESIERRETAVRWSRRLHGRGFNTVAFSEEVCDDVRALLRRYKEGWSMIRCNDAGIFL
TWKEQPVVWASAWRP
```

SEQ ID NO: 242, DNA - Oryza sativa - GOS2 promoter
```
AATCCGAAAAGTTTCTGCACCGTTTTCACCCCCTAACTAACAATATAGGGAACGTGTGCTAAATATAA
AATGAGACCTTATATATGTAGCGCTGATAACTAGAACTATGCAAGAAAAACTCATCCACCTACTTTAG
TGGCAATCGGGCTAAATAAAAAAGAGTCGCTACACTAGTTTCGTTTTCCTTAGTAATTAAGTGGGAAA
ATGAAATCATTATTGCTTAGAATATACGTTCACATCTCTGTCATGAAGTTAAATTATTCGAGGTAGCC
ATAATTGTCATCAAACTCTTCTTGAATAAAAAAATCTTTCTAGCTGAACTCAATGGGTAAAGAGAGAG
ATTTTTTTAAAAAAATAGAATGAAGATATTCTGAACGTATTGGCAAAGATTTAAACATATAATTATA
TAATTTTATAGTTTGTGCATTCGTCATATCGCACATCATTAAGGACATGTCTTACTCCATCCCAATTT
TTATTTAGTAATTAAAGACAATTGACTTATTTTTATTATTTATCTTTTTTCGATTAGATGCAAGGTAC
TTACGCACACACTTTGTGCTCATGTGCATGTGTGAGTGCACCTCCTCAATACACGTTCAACTAGCAAC
ACATCTCTAATATCACTCGCCTATTTAATACATTAGGTAGCAATATCTGAATTCAAGCACTCCACCA
TCACCAGACCACTTTTAATAATATCTAAAATACAAAAAATAATTTTACAGAATAGCATGAAAAGTATG
AAACGAACTATTTAGGTTTTTCACATACAAAAAAAAAAAGAATTTTGCTCGTGCGCGAGCGCCAATCT
CCCATATTGGGCACACAGGCAACAACAGAGTGGCTGCCCACAGAACAACCCACAAAAAACGATGATCT
AACGGAGGACAGCAAGTCCGCAACAACCTTTTAACAGCAGGCTTTGCGGCCAGGAGAGAGGAGGAGAG
GCAAAGAAAACCAAGCATCCTCCTTCTCCCATCTATAAATTCCTCCCCCCTTTTCCCCTCTCTATATA
GGAGGCATCCAAGCCAAGAAGAGGGAGAGCACCAAGGACACGCGACTAGCAGAAGCCGAGCGACCGCC
TTCTCGATCCATATCTTCCGGTCGAGTTCTTGGTCGATCTCTTCCCTCCTCCACCTCCTCCTCACAGG
GTATGTGCCTCCCTTCGGTTGTTCTTGGATTTATTGTTCTAGGTTGTGTAGTACGGGCGTTGATGTTA
GGAAAGGGATCTGTATCTGTGATGATTCCTGTTCTTGGATTTGGGATAGAGGGGTTCTTGATGTTGC
ATGTTATCGGTTCGGTTTGATTAGTAGTATGGTTTTCAATCGTCTGGAGAGCTCTATGGAAATGAAAT
GGTTTAGGGATCGGAATCTTGCGATTTTGTGAGTACCTTTTGTTTGAGGTAAAATCAGAGCACCGGTG
ATTTTGCTTGGTGTAATAAAGTACGGTTGTTTGGTCCTCGATTCTGGTAGTGATGCTTCTCGATTTGA
CGAAGCTATCCTTTGTTTATTCCCTATTGAACAAAAATAATCCAACTTTGAAGACGGTCCCGTTGATG
```

```
AGATTGAATGATTGATTCTTAAGCCTGTCCAAAATTTCGCAGCTGGCTTGTTTAGATACAGTAGTCCC
CATCACGAAATTCATGGAAACAGTTATAATCCTCAGGAACAGGGGATTCCCTGTTCTTCCGATTTGCT
TTAGTCCCAGAATTTTTTTTCCCAAATATCTTAAAAAGTCACTTTCTGGTTCAGTTCAATGAATTGAT
TGCTACAAATAATGCTTTTATAGCGTTATCCTAGCTGTAGTTCAGTTAATAGGTAATACCCCTATAGT
TTAGTCAGGAGAAGAACTTATCCGATTTCTGATCTCCATTTTTAATTATATGAAATGAACTGTAGCAT
AAGCAGTATTCATTTGGATTATTTTTTTTATTAGCTCTCACCCCTTCATTATTCTGAGCTGAAAGTCT
GGCATGAACTGTCCTCAATTTTGTTTTCAAATTCACATCGATTATCTATGCATTATCCTCTTGTATCT
ACCTGTAGAAGTTTCTTTTTGGTTATTCCTTGACTGCTTGATTACAGAAAGAAATTTATGAAGCTGTA
ATCGGGATAGTTATACTGCTTGTTCTTATGATTCATTTCCTTTGTGCAGTTCTTGGTGTAGCTTGCCA
CTTTCACCAGCAAAGTTC
```

SEQ ID NO: 243, DNA – Artificial sequence – prm07341
```
GGGGACAAGTTTGTACAAAAAAGCAGGCTTAAACAATGGATACTCTCTTTAGACTAGTCA
```

SEQ ID NO: 244, DNA – Artificial sequence – prm07342
```
GGGGACCACTTTGTACAAGAAAGCTGGGTAAATAAAAACAACCCTTTACG
```

FIGURE 17 (continued)

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/EP2008/068129, filed Dec. 22, 2008, which claims benefit of European application 07123820.8, filed Dec. 20, 2007; European Application 07124011.3, filed Dec. 21, 2007; European Application 07124036.0, filed Dec. 21, 2007; European Application 07025090.7, filed Dec. 24, 2007; U.S. Provisional Application 61/027,155, filed Feb. 8, 2008; U.S. Provisional Application 61/027,105, filed Feb. 8, 2008; U.S. Provisional Application 61/027,513, filed Feb. 11, 2008; and U.S. Provisional Application 61/027,499, filed Feb. 11, 2008.

This application claims priority benefit of the following applications: EP 07123820.8, filed Dec. 20, 2007; U.S. 61/027,513, filed Feb. 11, 2008; EP 07124011.3, filed Dec. 21, 2007; U.S. 61/027,105, filed Feb. 8, 2008; EP 07124036.0, filed Dec. 21, 2007; U.S. 61/027,155, filed Feb. 8, 2008; EP 07125090.7, filed Dec. 24, 2007; and U.S. 61/027,499, filed Feb. 11, 2008; the entire contents of each of which being hereby incorporated by reference.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing_13311_00069. The size of the text file is 645 KB, and the text file was created on Oct. 19, 2012.

The present invention relates generally to the field of molecular biology and concerns a method for enhancing various yield-related traits in plants by modulating expression in a plant of a nucleic acid encoding a TCP1 or a TCP2 transcription factor. The present invention also concerns plants having modulated expression of a nucleic acid encoding a TCP1 or TCP2 polypeptide, which plants have enhanced yield-related traits relative to corresponding wild type plants or other control plants. The invention also provides constructs useful in the methods of the invention.

In another embodiment, the present invention concerns a method for improving various plant growth characteristics by modulating expression in a plant of a nucleic acid encoding an Epsin-like polypeptide. The present invention also concerns plants having modulated expression of a nucleic acid encoding an Epsin-like polypeptide, which plants have improved growth characteristics relative to corresponding wild type plants or other control plants. The invention also provides constructs useful in the methods of the invention.

In yet another embodiment, the present invention concerns a method for increasing various plant yield-related traits by increasing expression in the seeds of a plant, of a nucleic acid sequence encoding a tRNA delta(2)-isopentenylpyrophosphate transferase (IPPT) polypeptide. The present invention also concerns plants having increased expression in the seeds, of a nucleic acid sequence encoding an IPPT polypeptide, which plants have increased yield-related traits relative to control plants. The invention additionally relates to nucleic acid constructs, vectors and plants containing said nucleic acid sequences.

In further embodiment, the present invention concerns a method for enhancing yield-related traits in plants grown under conditions of sub-optimal nutrient availability, comprising modulating expression in a plant of a nucleic acid encoding a SHORT-ROOT (SHR) polypeptide. The present invention also provides a method for increasing Thousand Kernel Weight (TKW) in plants relative to control plants, comprising modulating expression of a nucleic acid encoding an SHR polypeptide in a plant grown under grown under non-nutrient limiting conditions. The present invention also concerns plants having modulated expression of a nucleic acid encoding an SHR polypeptide, which plants have enhanced yield-related traits relative to corresponding wild type plants or other control plants. The invention also provides constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Plant biomass is yield for forage crops like alfalfa, silage corn and hay. Many proxies for yield have been used in grain crops. Chief amongst these are estimates of plant size. Plant size can be measured in many ways depending on species and developmental stage, but include total plant dry weight, above-ground dry weight, above-ground fresh weight, leaf area, stem volume, plant height, rosette diameter, leaf length, root length, root mass, tiller number and leaf number. Many species maintain a conservative ratio between the size of different parts of the plant at a given developmental stage.

These allometric relationships are used to extrapolate from one of these measures of size to another (e.g. Tittonell et al 2005 Agric Ecosys & Environ 105: 213). Plant size at an early developmental stage will typically correlate with plant size later in development. A larger plant with a greater leaf area can typically absorb more light and carbon dioxide than a smaller plant and therefore will likely gain a greater weight during the same period (Fasoula & Tollenaar 2005 Maydica 50:39). This is in addition to the potential continuation of the micro-environmental or genetic advantage that the plant had to achieve the larger size initially. There is a strong genetic component to plant size and growth rate (e.g. ter Steege et al 2005 Plant Physiology 139:1078), and so for a range of diverse genotypes plant size under one environmental condition is likely to correlate with size under another (Hittalmani et al 2003 Theoretical Applied Genetics 107:679). In this way a standard environment is used as a proxy for the diverse and dynamic environments encountered at different locations and times by crops in the field.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

Harvest index, the ratio of seed yield to aboveground dry weight, is relatively stable under many environmental conditions and so a robust correlation between plant size and grain yield can often be obtained (e.g. Rebetzke et al 2002 Crop Science 42:739). These processes are intrinsically linked because the majority of grain biomass is dependent on current or stored photosynthetic productivity by the leaves and stem of the plant (Gardener et al 1985 Physiology of Crop Plants. Iowa State University Press, pp 68-73). Therefore, selecting for plant size, even at early stages of development, has been used as an indicator for future potential yield (e.g. Tittonell et al 2005 Agric Ecosys & Environ 105: 213). When testing for the impact of genetic differences on stress tolerance, the ability to standardize soil properties, temperature, water and nutrient availability and light intensity is an intrinsic advantage of greenhouse or plant growth chamber environments compared to the field. However, artificial limitations on yield due to poor pollination due to the absence of wind or insects, or insufficient space for mature root or canopy growth, can restrict the use of these controlled environments for testing yield differences. Therefore, measurements of plant size in early development, under standardized conditions in a growth chamber or greenhouse, are standard practices to provide indication of potential genetic yield advantages.

A further important trait is that of improved abiotic stress tolerance. Abiotic stress is a primary cause of crop loss worldwide, reducing average yields for most major crop plants by more than 50% (Wang et al., Planta (2003) 218: 1-14). Abiotic stresses may be caused by drought, salinity, extremes of temperature, chemical toxicity, excess or deficiency of nutrients (macroelements and/or microelements), radiation and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield-related traits (seed yield and/or biomass) in plants may be through modification of the inherent growth mechanisms of a plant, such as the cell cycle or various signalling pathways involved in plant growth or in defence mechanisms.

It has now been found that various yield-related traits may be improved in plants by modulating expression in a plant of a nucleic acid encoding a TCP1 or a TCP2 or an Epsin-like, or an SHR polypeptide as defined herein.

In another embodiment, it has been found that various yield-related traits may be increased in plants relative to control plants, by increasing expression in the seeds of a plant, of a nucleic acid sequence encoding a tRNA delta(2)-isopentenylpyrophosphate transferase (IPPT) polypeptide. The increased yield-related traits comprise one or more of: increased early vigour, increased aboveground biomass, increased total seed yield per plant, increased total number of seeds, increased number of filled seeds, increased number of flowers per panicles, and increased harvest index.

BACKGROUND

TCP1/TCP2 Polypeptides

Transcription factors are usually defined as proteins that show sequence-specific DNA binding affinity and that are capable of activating and/or repressing transcription. The *Arabidopsis thaliana* genome codes for at least 1533 transcriptional regulators, accounting for ~5.9% of its estimated total number of genes (Riechmann et al. (2000) Science 290: 2105-2109). The TCP family of transcription factors is named after its first characterized members (teosinte-branched1 (TB1), cycloidea (CYC) and PCNA factor (PCF); Cubas P et al. (1999) Plant J 18(2): 215-22). In *Arabidopsis thaliana*, more than 20 members of the TCP family polypeptides have been identified, and classified based on sequence similarity in the TCP domain into Class I (also called Group I or PCF group) transcription factors that positively regulate gene expression, and Class II (also called Group II or CYC-TB1 group) transcription factors that negatively regulate proliferation. All TCP transcription factors are characterized by a non-canonical predicted basic-Helix-Loop-Helix (bHLH), that is required for both DNA binding and homo- and hetero-dimerization (see Cubas et al. above).

Surprisingly, it has now been found that increasing expression in a plant of a nucleic acid sequence encoding a TCP1 or a TCP2 transcription factor gives plants having enhanced yield-related traits relative to control plants. The particular subgroup of TCP polypeptides suitable for enhancing yield-related traits is described in detail below.

According to one embodiment, there is provided a method for enhancing yield-related traits in plants relative to control plants, comprising modulating expression of a nucleic acid encoding a TCP1 or a TCP2 polypeptide in a plant.

Epsin-Like Proteins

Eukaryotic cells possess an elaborate membrane system that functions in uptake of molecules (endocytosis) or in delivery of molecules to the cell exterior (secretory pathway). The secretory pathway leads from the endoplasmatic reticulum via the Golgi apparatus to the cell membrane. The endocytic pathway goes from the cell membrane to the cell interior. All these pathways make use of vesicles that budd off from the organelle where they originate from and which are highly selective with respect to the content they have and to their destination. Newly synthesised proteins need to be transported to the different subcellular locations or exported to the extracellular environment. Intracellular trafficking is controlled by many proteins, which are for example part of the vesicle, or assist in vesicle formation or fusion, or regulate the trafficking or assist in selection of cargo proteins etc. Many of these proteins are shared among plants, yeast and animals, indicating that the intracellular trafficking machinery is conserved among eukaryotes. One such group of proteins is characterised by the presence of a conserved "Epsin N-Terminal Homology" (ENTH) domain. The ENTH domain is capable of binding to phosphatidylinositols and therefore thought to play a role in targeting these proteins to specific compartments and assist in clathrin-mediated budding. ANTH (AP180 N-Terminal homology) domains are postulated to have a similar function as ENTH domains, but are part of structurally different proteins.

Epsin-like proteins all comprise an ENTH domain, and are postulated to play similar roles in clathrin-coated vesicle formation; Epsin-like proteins are reported to interact with various proteins (Lee et al., Plant Physiology 143, 1561-1575, 2007; Song et al., Plant Cell 18, 2258-2274, 2006).

Adenylate-1 PTs (AMP Isopentyltransferases/ATP/ADP Isopentyltransferases)

Phytohormones control plant growth and development, in response to endogenous and environmental stimuli. Examples of phytohormones include abscisic acid, auxins, cytokinins, ethylene, gibberellins, brassinolides, salicyclic acid, jasmonates, signalling peptides, and systemin.

In plants, naturally occurring cytokinins (CKs) constitute a group of adenine derivatives carrying either an isopentenyl side chain (isoprenoid CKs; most abundant type) or an aromatic group (aromatic CKs; rare), and play an essential role in plant development. The first and rate-limiting step of the biosynthesis of isoprenoid CKs is catalyzed by isopentenyl-transferases, which transfer the isopentenyl moiety from delta (2)-dimethylallyl diphosphate (DMAPP) or hydroxymethyl-butenyl diphosphate (HMBDP) to position $N^6$ on a conjugated adenine. The isopentyltransferases can be subdivided into three subgroups, depending on which conjugated adenine they utilize:

1) AMP isopentyltransferases (also named DMAPP:AMP isopentyltransferase, EC 2.5.1.27), which preferentially use adenosine 5'-monophosphate as acceptor molecule; typical examples are found in phytopathogenic bacteria, such as in, *Agrobacterium tumefaciens, Pseudomonas syringae, Pseudomonas solanacearum (Ralstonia solanacearum)* and *Pantoea agglomerans (Erwinia herbicola)*, nitrogen-fixing symbiotic cyanobacterium *Nostoc*, or slime mold *Disctyostelium discoideum*.
2) ATP/ADP isopentyltransferases (also named DMAPP: ATP/ADP isopentyltransferase), which preferentially use adenosine 5'-triphosphate or adenosine 5'-diphosphate as acceptor molecule; for example 8 ATP/ADP isopentyltransferases are found in *Arabidopsis thaliana* (Miyawaki et al (2006) Proc Natl Acad Sci USA 103 (44): 16598-16603).
3) tRNA isopentyltransferases (also named DMAPP: tRNA isopentyltransferase, or tRNA delta(2) isopentenyl pyrophosphate transferase (IPPT), EC 2.5.1.8), which preferentially use adenine at position 37 of certain tRNAs (located in the cytoplasm, in the plastids and in the mitochondria), next to the anticodon; the enzyme has been purified and the gene cloned from bacteria, yeast, animals, and plants.

The two first subgroups (collectively named adenylate-IPTs) catalyse the direct de novo biosynthesis of free cytokinins, essentially constituted of isopentenyladenine (iP)-types and transzeatin (tZ)-types of cytokinins. The third subgroup (named tRNA-IPTs or IPPTs) catalyses cytokinin formation by isopentenylation of tRNA, which when degraded liberates cytokinin nucleotides, which in turn will be used to biosynthesize cis-zeatin (cZ)-types of cytokinins. Thus, the rate of tRNA turnover also strongly determines the availability of free cytokinin nucleotides.

While tRNA is a common source of free cytokinins in prokaryotes (Koenig et al. (2002) J Bacteriol 184:1832-1842), both tRNA- and adenylate-IPT pathways contribute to cytokinin biosynthesis in seed plants (Miyawaki et al. (2006) Proc Natl Acad Sci USA 103(44): 16598-16603). However, the tRNA pathway is generally considered to be insufficient to account for a significant source of cytokinins in seed plants. In conclusion, the two biosynthetic pathways lead to the synthesis of different cytokinins, and in different proportions.

Both adenylate-IPTs and tRNA-IPTs have in their N-terminus the ATP/GTP P-loop binding motif (A, G)-X4-G-K-(S, T). Another well-known conserved region specific to eucaryotic tRNA-IPTs and absent in prokaryotic tRNA-IPTs, is located at the C-terminus: the Zn-finger-like motif C2H2 (C-X2-C-X(12,18)-H-X5-H. The function of Zn-finger-like motif in tRNA-IPTs is possibly in connection with protein-protein interactions and nuclear localisation (Golovko et al. (2000) Gene 258: 85-93).

When an adenylate-IPT from *Agrobacterium tumefaciens* was constitutively overexpressed in plants, or expressed at weaker or conditionally, these showed the typical effects of cytokinin overproduction, such as uncontrolled axillary bud growth (reduced apical dominance), the formation of small curling leaves, delayed root formation, and modified senescence (for example, Luo et al. (2005) Plant Growth Regulation 47:1-47, and references therein)

Transgenic *Arabidopsis* and canola plants expressing a bacterial adenylate-IPT under the control of a seed-specific promoter had an average seed yield per plant that was not significantly increased compared to control plants (Roeckel et al. (1997) Transgenic Res 6(2):133-41).

US patent application 2006/0010515 describes transgenic *Arabidopsis thaliana* plants expressing an adenylate-IPT from *Agrobacterium tumefaciens* using independently three cell-cycle regulated promoters, which plants have increased leaf size/vegetative mass, increased plant height, increased branch number, increased flower and silique number.

Short Root (SHR)

Members of the GRAS gene family (an acronym based on the designations of known genes: GAI, RGA and SCR) encode transcriptional regulators that have diverse functions in plant growth and development, such as gibberellin signal transduction, root radial patterning, axillary meristem formation, phytochrome A signal transduction, and gametogenesis. Phylogenetic analysis divides the GRAS gene family into eight subfamilies, which have distinct conserved domains and functions (Tian et al., 2004 (Plant Molecular Biology, Volume 54, Number 4, pp 519-532). GRAS proteins contain a conserved region of about 350 amino acids that can be divided in 5 motifs, found in the following order: leucine heptad repeat I, the VHIID motif, leucine heptad repeat II, the PFYRE motif and the SAW motif. SHORT ROOT, or SHR, is a member of the GRAS family of plant transcription factors and is a protein involved in root development.

Granted U.S. Pat. No. 6,927,320 B1 describes SHR genes and discloses that SHR gene expression controls cell division of certain cell types in roots, affects the organisation of root and stem, and affects gravitropism of aerial structures. It is suggested that modulation of SHR expression levels can be used to modify root and aerial structures of transgenic plants and enhance the agronomic properties of such plants. It is also suggested that plants engineered with SHR overexpression may exhibit improved vigorous growth characteristics which may be identified by examining any of the following parameters: 1. the rate of growth, 2. vegetative yield of the mature plant, 3. seed or fruit yield, 4. seed or fruit weight, 5. total nitrogen content of the plant, 6. total nitrogen content of the fruit or seed, 7. the free amino acid content of the plant, 8. the free amino acid content of the fruit or seed, 9. the total protein content of the plant, and 10. total protein content of the fruit or seed.

SUMMARY

Surprisingly, it has now been found that modulating expression of a nucleic acid encoding a TCP1 or a TCP2 polypeptide gives plants having enhanced yield-related traits, in particular increased yield and seed yield relative to control plants.

Also surprisingly, it has been found that modulating expression of a nucleic acid encoding an Epsin-like polypeptide gives plants having enhanced yield-related traits, in particular increased yield and/or increased early vigour relative to control plants.

According one embodiment, there is provided a method for improving yield related traits of a plant relative to control plants, comprising modulating expression of a nucleic acid encoding an Epsin-like polypeptide in a plant. The improved yield related traits comprised increased yield and/or increased early vigour.

Furthermore, surprisingly, it has been found that increasing expression in the seeds of a plant, of a nucleic acid sequence encoding an IPPT polypeptide as defined herein, gives plants having increased yield-related traits relative to control plants.

According to one embodiment, there is provided a method for increasing yield-related traits in plants relative to control plants, comprising increasing expression in the seeds of a plant, of a nucleic acid sequence encoding an IPPT polypeptide as defined herein. The increased yield-related traits comprise one or more of: increased early vigour, increased aboveground biomass, increased total seed yield per plant, increased total number of seeds, increased number of filled seeds, increased number of flowers per panicles, and increased harvest index.

Furthermore, surprisingly, it has been found that modulating expression of a nucleic acid encoding an SHR polypeptide in plants grown under conditions of sub-optimal nutrient availability gives the plants enhanced yield-related traits relative to control plants. It has also surprisingly been found that modulating expression of a nucleic acid encoding an SHR polypeptide in plants grown under non-nutrient limiting conditions gives the plants increased Thousand Kernel Weight (TKW) relative to control plants.

According one embodiment of the present invention, there is therefore provided a method for enhancing plant yield related traits relative to control plants, comprising modulating expression of a nucleic acid encoding an SHR polypeptide in a plant grown under conditions of sub-optimal nutrient availability.

According to another embodiment of the present invention, there is provided a method for increasing Thousand Kernel Weight (TKW) in plants relative to control plants, comprising modulating expression of a nucleic acid encoding an SHR polypeptide in plants grown under non-nutrient limiting conditions.

DEFINITIONS

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
|---------|---------------------------|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

Motif/Consensus Sequence/Signature

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m = 81.5° C. + 16.6x \log_{10} [Na^+]^a + 0.41x \% [G/C^b] - 500x/[L^c]^{-1} - 0.61x \% \text{ formamide}$$

2) DNA-RNA or RNA-RNA hybrids:

$$Tm = 79.8 + 18.5(\log_{10} [Na^+]^a) + 0.58(\% G/C^b) + 11.8(\% G/C^b)^2 - 820/L^c$$

3) oligo-DNA or oligo-RNA$^d$ hybrids:

For <20 nucleotides: $T_m = 2(l_n)$

For 20-35 nucleotides: $T_m = 22 + 1.46(l_n)$ $^a$ or for other monovalent cation, but only accurate in the 0.01-0.4 M range.
$^b$ only accurate for % GC in the 30% to 75% range.
$^c$ L=length of duplex in base pairs.
$^d$ oligo, oligonucleotide; $l_n$, =effective length of primer=2× (no. of G/C)+(no. of NT).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3$^{rd}$ Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (IN-DELs). The size of INDELs is usually less than 100 bp. SNPs and INDELs form the largest set of sequence variants in naturally occurring polymorphic strains of most organisms.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a level that is in all instances below that obtained under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
| --- | --- |
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
| --- | --- |
| RCc3 | Plant Mol Biol. 1995 January; 27(2): 237-48 |
| Arabidopsis PHT1 | Kovama et al., 2005; |
|  | Mudge et al. (2002, Plant J. 31: 341) |
| Medicago phosphate transporter | Xiao et al., 2006 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U.S. Pat. No. 5,401,836 |
| SbPRP1 | Suzuki et al., Plant Mol. Biol. 21: 109-119, 1993. |
| LRX1 | Baumberger et al. 2001, Genes & Dev. 15: 1128 |
| BTG-26 Brassica napus | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 153: 386-395, 1991. |
| KDC1 (Daucus carota) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (Arabidopsis) | Diener et al. (2001, Plant Cell 13: 1625) |
| NRT2;1Np (N. plumbaginifolia) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be an endosperm and/or aleurone and/or embryo specific. Examples of seed-specific promoters are shown in Table 2c to 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
| --- | --- |
| seed-specific genes | Simon et al., Plant Mol. Biol. 5: 191, 1985; |
|  | Scofield et al., J. Biol. Chem. 262: 12202, 1987.; |
|  | Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; |
|  | Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley ltr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| sorghum α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |

TABLE 2c-continued

Examples of seed-specific promoters

| Gene source | Reference |
|---|---|
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d examples of endosperm-specific promoters

| Gene source | Reference |
|---|---|
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| Synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| *sorghum* kafirin | DeRose et al. (1996) Plant Mol Biol 32: 1029-35 |

TABLE 2e

Examples of embryo specific promoters:

| Gene source | Reference |
|---|---|
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

Examples of aleurone-specific promoters:

| Gene source | Reference |
|---|---|
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

Examples of green tissue-specific promoters

| Gene | Expression | Reference |
| --- | --- | --- |
| Maize Orthophosphate dikinase | Leaf specific | Fukayama et al., 2001 |
| Maize Phosphoenolpyruvate carboxylase | Leaf specific | Kausch et al.,2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

Examples of meristem-specific promoters

| Gene source | Expression pattern | Reference |
| --- | --- | --- |
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants. Methods for decreasing expression are known in the art and the skilled person would readily be able to adapt the known methods for silencing so as to achieve reduction of expression of an endogenous gene in a whole plant or in parts thereof through the use of an appropriate promoter, for example.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. mRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with Agrobacteria, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or (b) genetic control sequence(s) which is operably linked with the nucleic acid sequence according to the invention, for example a promoter, or (c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [ Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990) EMBO J 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.
Increase/Improve/Enhance The terms "increase", "improve" or "enhance" are interchangeable and shall mean in the sense of the application in case of TCP1, TCP2, Epsin-like or SHR-encoding nucleic acids or TCP1, TCP2, Epsin-like or SHR-polypeptides at least a 3%, 4%, 5%, 6%, 7%, 8%, 9% or 10%, preferably at least 15% or 20%, more preferably 25%, 30%, 35% or 40% more yield and/or growth in comparison to control plants as defined herein and in case of IPPT-encoding nucleic acids or IPPT-polypeptides at least a 5%, 6%, 7%, 8%, 9%, or 10%, preferably at least 15% or 20%, more preferably 25%, 30%, 35% or 40% more yield and/or growth in comparison to control plants as defined herein.
Seed Yield Increased seed yield may manifest itself as one or more of the following: a) an increase in seed biomass (total seed weight) which may be on an individual seed basis and/or per plant and/or per square meter; b) increased number of flowers per panicle and/or per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; f) increased thousand kernel weight (TKW) and g) increased number of primary panicles, which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased yield may also result in modified architecture, or may occur because of modified architecture.
Greenness Index The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.
Plant The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum integrifolium* or *Solanum lycopersicum*), *Sorghum bicolor*, *Spinacia* spp., *Syzygium* spp., *Tagetes* spp., *Tamarindus indica*, *Theobroma cacao*, *Trifolium* spp., *Triticale* sp., *Triticosecale rimpaui*, *Triticum* spp. (e.g. *Triticum aestivum*, *Triticum durum*, *Triticum turgidum*, *Triticum hybernum*, *Triticum macha*, *Triticum sativum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amongst others.

DETAILED DESCRIPTION OF THE INVENTION

Surprisingly, it has now been found that modulating expression in a plant of a nucleic acid encoding a TCP1 or a TCP2 polypeptide or an Epsin-like polypeptide gives plants having enhanced yield-related traits relative to control plants. According to a first embodiment, the present invention provides a method for enhancing yield-related traits in plants relative to control plants, comprising modulating expression in a plant of a nucleic acid encoding a TCP1 or a TCP2 polypeptide or an Epsin-like polypeptide.

A preferred method for modulating (preferably, increasing) expression of a nucleic acid encoding a TCP1 or a TCP2 polypeptide is by introducing and expressing in a plant a nucleic acid encoding a TCP1 or a TCP2 polypeptide or an Epsin-like polypeptide.

Furthermore, surprisingly, it has been found that increasing expression in the seeds of a plant, of a nucleic acid sequence encoding an IPPT polypeptide as defined herein, gives plants having increased yield-related traits relative to control plants. According to a first embodiment, the present invention provides a method for increasing yield-related traits in plants relative to control plants, comprising increasing expression in the seeds of a plant, of a nucleic acid sequence encoding an IPPT polypeptide.

A preferred method for increasing expression in the seeds of a plant, of a nucleic acid sequence encoding an IPPT polypeptide is by introducing and expressing in the seeds of a plant, a nucleic acid sequence encoding an IPPT polypeptide.

Also surprisingly, it has been found that modulating expression of a nucleic acid encoding an SHR polypeptide in plants grown under conditions of sub-optimal nutrient availability gives the plants enhanced yield-related traits relative to control plants. It has also surprisingly been found that modulating expression of a nucleic acid encoding an SHR polypeptide in plants grown under non nutrient-limiting conditions gives the plants increased Thousand Kernel Weight (TKW) relative to control plants.

According one embodiment, there is provided a method for enhancing yield related traits relative to control plants, comprising modulating expression of a nucleic acid encoding an SHR polypeptide in plants grown under conditions of sub-optimal nutrient availability.

According to another embodiment of the present invention, there is provided a method for increasing Thousand Kernel Weight (TKW) in plants relative to control plants, comprising modulating expression of a nucleic acid encoding an SHR polypeptide in plants grown under non-nutrient limiting conditions.

A preferred method for modulating (preferably, increasing) expression of a nucleic acid encoding an SHR polypeptide is by introducing and expressing in a plant a nucleic acid encoding an SHR polypeptide.

Concerning TCP1 or a TCP2 polypeptides/genes, any reference hereinafter to a "protein useful in the methods of the invention" is taken to mean a TCP1 or a TCP2 polypeptide as defined herein. Any reference hereinafter to a "nucleic acid useful in the methods of the invention" is taken to mean a nucleic acid capable of encoding such a TCP1 or a TCP2 polypeptide. The nucleic acid to be introduced into a plant (and therefore useful in performing the methods of the invention) is any nucleic acid encoding the type of protein which will now be described, also referred to as a "TCP1 nucleic acid" or "TCP1 gene" or "TCP2 nucleic acid" or "TCP2 gene".

Regarding Epsin-like polypeptides/genes, any reference hereinafter to a "protein useful in the methods of the invention" is taken to mean an Epsin-like polypeptide as defined herein. Any reference hereinafter to a "nucleic acid useful in the methods of the invention" is taken to mean a nucleic acid capable of encoding such an Epsin-like polypeptide. The nucleic acid to be introduced into a plant (and therefore useful in performing the methods of the invention) is any nucleic acid encoding the type of protein which will now be described, hereafter also named "Epsin-like nucleic acid" or "Epsin-like gene".

Concerning IPPT polypeptides/genes, any reference hereinafter to a "protein useful in the methods of the invention" is taken to mean an IPPT polypeptide as defined herein. Any reference hereinafter to a "nucleic acid sequence useful in the methods of the invention" is taken to mean a nucleic acid sequence capable of encoding such an IPPT polypeptide. The nucleic acid sequence to be introduced into a plant (and therefore useful in performing the methods of the invention) is any nucleic acid sequence encoding the type of polypeptide, which will now be described, hereafter also named "IPPT nucleic acid sequence" or "IPPT gene".

Regarding SHR polypeptides/genes, any reference hereinafter to a "protein useful in the methods of the invention" is taken to mean an SHR polypeptide as defined herein. Any reference hereinafter to a "nucleic acid useful in the methods of the invention" is taken to mean a nucleic acid capable of encoding such an SHR polypeptide. The nucleic acid to be introduced into a plant (and therefore useful in performing the methods of the invention) is any nucleic acid encoding the type of protein which will now be described, hereinafter also named "SHR nucleic acid" or "SHR gene".

A "TCP1 polypeptide" as defined herein refers to any polypeptide comprising:
(i) a TCP domain having in increasing order of preference at least 50%, 55%, 60%, 65%, 70%, 75%, 80%, 85%, 90%, 95% or more sequence identity to the TCP domain of any one of the sequences indicated in FIG. 1; and
(ii) a domain having in increasing order of preference at least 50%, 55%, 60%, 65%, 70%, 75%, 80%, 85%, 90%, 95% or more sequence identity to Domain A of any one of the sequences indicated in FIG. 1; and
(iii) a domain having in increasing order of preference at least 50%, 55%, 60%, 65%, 70%, 75%, 80%, 85%, 90%, 95% or more sequence identity to Domain B of any one of the sequences indicated in FIG. 1; and
(iv) a domain having in increasing order of preference at least 50%, 55%, 60%, 65%, 70%, 75%, 80%, 85%, 90%, 95% or more sequence identity to Domain C of any one of the sequences indicated in FIG. 1.

According to a preferred embodiment, the TCP1 polypeptide comprises:
(i) a TCP domain having in increasing order of preference at least 50%, 55%, 60%, 65%, 70%, 75%, 80%, 85%, 90%, 95% or more sequence identity to the TCP domain of the sequence represented by Ms_TCP_sugar in FIG. 1; and
(ii) a domain having in increasing order of preference at least 50%, 55%, 60%, 65%, 70%, 75%, 80%, 85%, 90%, 95% or more sequence identity to Domain A of the sequence represented by Ms_TCP_sugar in FIG. 1; and
(iii) a domain having in increasing order of preference at least 50%, 55%, 60%, 65%, 70%, 75%, 80%, 85%, 90%, 95% or more sequence identity to Domain B of the sequence represented by Ms_TCP_sugar in FIG. 1; and
(iv) a domain having in increasing order of preference at least 50%, 55%, 60%, 65%, 70%, 75%, 80%, 85%, 90%, 95% or more sequence identity to Domain C of the sequence represented by Ms_TCP_sugar in FIG. 1.

A "TCP2 polypeptide" as defined herein refers to any polypeptide comprising:
(i) a TCP domain having in increasing order of preference at least 50%, 55%, 60%, 65%, 70%, 75%, 80%, 85%, 90%, 95% or more sequence identity to the TCP domain of any of the sequences indicated in FIG. 2; and
(ii) a domain having in increasing order of preference at least 50%, 55%, 60%, 65%, 70%, 75%, 80%, 85%, 90%, 95% or more sequence identity to Domain 1 of any of the sequences indicated in FIG. 2; and (iii) a domain having in increasing order of preference at least 50%, 55%, 60%, 65%, 70%, 75%, 80%, 85%, 90%, 95% or more sequence identity to Domain 2 of any of the sequences indicated in FIG. 2; and
(iv) a domain having in increasing order of preference at least 50%, 55%, 60%, 65%, 70%, 75%, 80%, 85%, 90%, 95% or more sequence identity to Domain 3 of any of the sequences indicated in FIG. 2.

According to a preferred embodiment, the TCP2 polypeptide comprises:
(i) a TCP domain having in increasing order of preference at least 50%, 55%, 60%, 65%, 70%, 75%, 80%, 85%, 90%, 95% or more sequence identity to the TCP domain of the sequence represented by Mt_TCP2_sugar in FIG. 2; and
(ii) a domain having in increasing order of preference at least 50%, 55%, 60%, 65%, 70%, 75%, 80%, 85%, 90%, 95% or more sequence identity to Domain 1 of the sequence represented by Mt_TCP2_sugar in FIG. 2; and
(iii) a domain having in increasing order of preference at least 50%, 55%, 60%, 65%, 70%, 75%, 80%, 85%, 90%, 95% or more sequence identity to Domain 2 of the sequence represented by Mt_TCP2_sugar in FIG. 2; and
(iv) a domain having in increasing order of preference at least 50%, 55%, 60%, 65%, 70%, 75%, 80%, 85%, 90%, 95% or more sequence identity to Domain 3 of the sequence represented by Mt_TCP2_sugar in FIG. 2.

In addition, the TCP polypeptide may comprise any one or both of:
(v) a domain having in increasing order of preference at least 50%, 55%, 60%, 65%, 70%, 75%, 80%, 85%, 90%, 95% or more sequence identity to Domain 4 of any of the sequences indicated in FIG. 2;
(vi) a domain having in increasing order of preference at least 50%, 55%, 60%, 65%, 70%, 75%, 80%, 85%, 90%, 95% or more sequence identity to Domain 5 of any of the sequences indicated in FIG. 2.

Preferably, Domain 4 has in increasing order of preference at least 50%, 55%, 60%, 65%, 70%, 75%, 80%, 85%, 90%, 95% or more sequence identity to Domain 4 of the sequence represented by Mt_TCP2_sugar in FIG. 2.

Preferably, Domain 5 has in increasing order of preference at least 50%, 55%, 60%, 65%, 70%, 75%, 80%, 85%, 90%, 95% or more sequence identity to Domain 5 of the sequence represented by Mt_TCP2_sugar in FIG. 2.

The TCP1 or TCP2 protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 2 or SEQ ID NO: 4 respectively. The overall sequence identity is determined using a global alignment algorithm, such as the Needleman Wunsch algorithm in the program GAP (GCG Wisconsin Package, Accelrys), preferably with default parameters. Compared to overall sequence identity, the sequence identity will generally be higher when only conserved domains or motifs are considered.

Preferably, the TCP1 or TCP2 polypeptide sequence which when used in the construction of a TCP phylogenetic tree, such as the one depicted in FIG. 2, clusters with the group of TCP1 or TCP2 polypeptides comprising the amino acid sequence represented by SEQ ID NO: 2 or SEQ ID NO: 4 rather than with any other group.

A "Epsin-like polypeptide" as defined herein refers to any polypeptide comprising an ENTH domain (SMART accession SM00273) in its N-terminal half. The ENTH domain is known in the art and is described in the InterPro database: The ENTH (Epsin N-terminal homology) domain is approximately 150 amino acids in length and is always found located at the N-termini of proteins. The domain forms a compact globular structure, composed of 9 alpha-helices connected by loops of varying length. The general topology is determined by three helical hairpins that are stacked consecutively with a right hand twist. An N-terminal helix folds back, forming a deep basic groove that forms the binding pocket for the Ins (1,4,5)P3 ligand. The ligand is coordinated by residues from surrounding alpha-helices and all three phosphates are multiply coordinated. The coordination of Ins(1,4,5)P3 suggests that ENTH is specific for particular head groups. Proteins containing this domain have been found to bind PtdIns(4,5)P2 and PtdIns(1,4,5)P3 suggesting that the domain may be a membrane interacting module. The main function of proteins containing this domain appears to be to act as accessory clathrin adaptors in endocytosis, Epsin is able to recruit and promote clathrin polymerisation on a lipid monolayer, but may have additional roles in signalling and actin regulation. Epsin causes a strong degree of membrane curvature and tubulation, even fragmentation of membranes with a high PtdIns(4,5)P2 content. Epsin binding to membranes facilitates their deformation by insertion of the N-terminal helix into the outer leaflet of the bilayer, pushing the head groups apart. This would reduce the energy needed to curve the membrane into a vesicle, making it easier for the clathrin cage to fix and stabilise the curved membrane. This points to a pioneering role for epsin in vesicle budding as it provides both a driving force and a link between membrane invagination and clathrin polymerisation (annotation IPR013809).

Preferably, the Epsin-like polypeptide useful in the methods of the present invention furthermore comprises two or more of the following motifs:
Motif 1: (V/I)(L/R)(D/E)AT(S/D/N)(N/D/E/S)E(P/S)WG-PHG(T/S/E) (SEQ ID NO: 48)
Preferably, Motif 1 is: (V/I)LDAT(S/D/N)(N/D)E(P/S)WG-PHG(T/S)
More preferably, Motif 1 is VLDATDNEPWGPHGT
Motif 2: F(Q/E)(Y/F)(I/L/V/R/K)(D/E)(S/P/A)(S/G/N/Q/R)G(R/K)D(Q/V/A/H/E)G(S/N/L/I/V)NVR (SEQ ID NO: 49)
Preferably, Motif 2 is: F(Q/E)(Y/F)(I/L/V)(D/E)(S/P)(S/G/N)G(R/K)D(Q/V/A)G(S/N/L/I)NVR
More preferably, Motif 2 is FEYVEPNGKDVGINVR
Motif 3: (E/S/A/Q)(V/I/E/A)R(Q/E/D/N)KA(A/L/V/E)(A/V/S/R/K)(N/T)(R/A)(D/E/N/G)K (SEQ ID NO: 50)
Preferably, Motif 3 is: (E/S/A)(V/I)R(Q/E/D/N)KA(A/L/V)(A/V/S)(N/T)R(D/E/N)K
More preferably, Motif 3 is EIRDKAVANRNK
Motif 4: WAD(T/S)LSRGL(V/I) (SEQ ID NO: 51)
Preferably, Motif 4 is: WADSLSRGLI
Motif 5: L(A/S)D(I/V)G(I/V)(D/V)(F/G)(D/E/P/G) (SEQ ID NO: 52)
Preferably, Motif 5 is: LADVGVVGD In addition to the previous motifs, the protein useful in the methods of the present invention preferably also comprises in its native form one or more of the following motifs:
Motif 6 (a to c): one of the following tetrapeptides: GGYG, GSYG or GGYD (SEQ ID NO: 53, 54, 55)
Motif 7 (a to d): one of the following tetrapeptides: SAAS, SSAS, SSAP, or SSAT (SEQ ID NO: 56, 57, 58, 59)
Motif 8 (a to e): one of the following tetrapeptides: DEFD, DFFD, DDDF, EDDF, or DDFD (SEQ ID NO: 60, 61, 62, 63, 64)

Alternatively, the homologue of an Epsin-like protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 44, provided that the homologous protein comprises two or more of the conserved motifs as outlined above. The overall sequence identity is determined using a global alignment algorithm, such as the Needleman Wunsch algorithm in the program GAP (GCG Wisconsin Package, Accelrys), preferably with default parameters. Compared to overall sequence identity, the sequence identity will generally be higher when only conserved domains or motifs are considered. For example, when the ENTH domain is compared among the Epsin-like polypeptides, the sequence identity will be much higher compared to the overall sequence identity.

Preferably, the polypeptide sequence which when used in the construction of a phylogenetic tree, such as the one depicted in FIG. 3 (Holstein and Oliviusson, Protoplasma 226, 13-21, 2005), clusters with the group of Epsin-like polypeptides comprising the amino acid sequence represented by SEQ ID NO: 44 rather than with any other group.

An "IPPT polypeptide" as defined herein refers to any polypeptide comprising (i) a tRNA isopentenyltransferase domain with an InterPro accession IPR002627; and (ii) an N-terminal ATP/GTP-binding site motif A (P-loop).

Alternatively or additionally, an "IPPT polypeptide" as defined herein refers to any polypeptide sequence having (i) in increasing order of preference at least 70%, 75%, 80%, 85%, 90%, 95%, 98%, 99% or more amino acid sequence identity to an N-terminal ATP/GTP-binding site motif A (P-loop) as represented by SEQ ID NO: 199; and having in increasing order of preference at least 70%, 75%, 80%, 85%, 90%, 95%, 98%, 99% or more amino acid sequence identity to one or more of: (ii) Conserved motif I DSR(Q/L)(V/L/I) as represented by SEQ ID NO: 200; or (ii) Conserved motif II (N/D/S/T)(I/V)GTAKP(T/S) as represented by SEQ ID NO: 201; or (iii) Conserved motif III L(V/A/I)GG(S/T)GLY as represented by SEQ ID NO:202; or (iv) Conserved motif IV F/Y/L)AK(R/K/Q)Q(R/K/M)TWFR as represented by SEQ ID NO:203.

Alternatively or additionally, an "IPPT polypeptide" as defined herein refers to any polypeptide having in increasing order of preference at least 35%, 40%, 45%, 50%, 55%, 60%, 65%, 70%, 75%, 80%, 85%, 90%, 95%, 98%, 99% or more amino acid sequence identity to the IPPT polypeptide as represented by SEQ ID NO: 144 or to any of the polypeptide sequences given in Table A4 herein.

Alternatively or additionally, an "IPPT polypeptide" is capable of complementing a yeast mod5 mutant strain which lacks endogenous IPPT activity, or is capable of complementing an E. coli miaA mutant strain which lacks endogenous IPPT activity.

An "SHR polypeptide" as defined herein refers to any full length polypeptide which when used in the construction of a GRAS phylogenetic tree, such as the one depicted in FIG. 14, clusters with the group of SHR polypeptides comprising the amino acid sequence represented by SEQ ID NO: 209 rather than with any other group.

SHR polypeptides, being members of the GRAS family of plant transcription factors, may comprise features typical of the GRAS gene family. Such typical features include a highly conserved C-terminal region, but variable N-terminal region. The highly conserved C-terminal region comprises five distinct motifs, typically found in the following order:
1. leucine heptad repeat (LHR1),
2. VHIID motif,
3. leucine heptad repeat II (LHR II),
4. PFYRE motif, and
5. SAW motif.

LHR I appears to consist of two repeat units that are separated by a spacer that often contains a proline residue, known to disrupt alpha-helical structures. The two units within LHR I are not in phase with each other. LHR IA is similar to LHRs found in other proteins, consisting of between three to five regular heptads. LHR IB is shorter, usually consisting of only two such repeats. In LHR II, specific leucine heptad repeats can be identified in this region in nearly all members of the GRAS family, the number of repeats is small, usually two or three.

The VHIID sequence is readily recognizable in all members of the family, although it is not absolutely conserved: substitutions of valine, isoleucine and leucine at the 1, 3 and 4 positions yield a number of permutations. Within the larger region that we term the VHIID motif, the P-N-H-D-Q-L residues are absolutely conserved. The spacing between the proline and asparagine residues is identical among all members, as is the spacing between the histidine, aspartate, glutamine and leucine residues. The VHIID motif is bounded at its C-terminus by a conserved sequence referred to as LRITG for simplicity.

Most of the deviations from this consensus sequence represent conservative changes.

In the PFYRE motif, P is absolutely conserved. Within the PFYRE domain, the sequences are largely co-linear and portions of this region show a high degree of sequence similarity among all members of the GRAS family.

The SAW motif is characterized by three pairs of absolutely conserved residues: R-E, W-G and W-W. The W-W pair found nearly at the C-terminus of these sequences shows absolute conservation of spacing, as does the W-G pair.

In addition to an SHR polypeptide clustering with other SHR polypeptides in a GRAS phylogenetic tree, preferably, the C-terminal region an SHR polypeptide useful in the methods of the invention has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the C-terminal region of the amino acid represented by SEQ ID NO: 209.

The overall sequence identity is determined using a global alignment algorithm, such as the Needleman Wunsch algorithm in the program GAP (GCG Wisconsin Package, Accelrys), preferably with default parameters. Compared to overall sequence identity, the sequence identity will generally be higher when only conserved domains or motifs are considered.

The term "domain" and "motif" is defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Analysis of the polypeptide sequence of SEQ ID NO: 144 is presented below in Example 4 herein. For example, an IPPT polypeptide as represented by SEQ ID NO: 144 comprises a tRNA isopentenyltransferase domain with an InterPro accession IPR002627. Domains may also be identified using routine techniques, such as by sequence alignment. An alignment of the polypeptides of Table A4 herein, is shown in FIG. 3. Such alignments are useful for identifying the most conserved domains or motifs between the IPPT polypeptides, such as the Conserved motifs as represented by SEQ ID NO: 200 to 203 (comprised in SEQ ID NO: 144).

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

Furthermore, TCP 1 and TCP2 polypeptides (at least in their native form) typically have DNA binding activity. Tools and techniques for measuring DNA binding activity are well known in the art. Further details are provided in Example 6.

In addition, TCP 1 and TCP2 polypeptides, when expressed in rice according to the methods of the present invention as outlined in the Examples section, give plants having increased yield related traits, in particular increased seed yield.

Furthermore, Epsin-like polypeptides (at least in their native form) typically have lipid binding activity. Tools and techniques for measuring lipid binding activity are well known in the art. For example, lipid binding by the ENTH domain is described by Hom et al. (J. Mol. Biol. 373, 412-423, 2007). Further details are provided in Example 6.

In addition, Epsin-like polypeptides, when expressed in rice according to the methods of the present invention as outlined in Examples 7 and 8, give plants having increased yield related traits, in particular one or more of increased total weight of seeds, fill rate, total number of seeds and number of filled seeds.

Example 3 herein describes in Table B4 the percentage identity between the IPPT polypeptide as represented by SEQ ID NO: 144 and the IPPT polypeptides listed in Table A4, which can be as low as 39% amino acid sequence identity.

The task of protein subcellular localisation prediction is important and well studied. Knowing a protein's localisation helps elucidate its function. Experimental methods for protein localization range from immunolocalization to tagging of proteins using green fluorescent protein (GFP) or beta-glucuronidase (GUS). Such methods are accurate although labor-intensive compared with computational methods. Recently much progress has been made in computational prediction of protein localisation from sequence data. Among algorithms well known to a person skilled in the art are available at the ExPASy Proteomics tools hosted by the Swiss Institute for Bioinformatics, for example, PSort, TargetP, ChloroP, LocTree, Predotar, LipoP, MITOPROT, PATS, PTS1, SignalP, TMHMM, and others.

Furthermore, IPPT polypeptides useful in the methods of the present invention (at least in their native form) typically are capable of transferring the isopentenyl moiety from delta (2)-dimethylallyl diphosphate (DMAPP) or hydroxymethylbutenyl diphosphate (HMBDP) to an adenine at position 37 of certain tRNAs. Many assays exist to measure such enzymatic activity, including complementation assays of a yeast strain with defective endogenous IPPT activity (encoded by the MOD5 gene; Golovko et al. (2002) Plant Molec Biol 49: 161-169), complementation assays of an E. coli strain with defective endogenous IPPT activity (encoded by the miaA gene; Dihanich et al. (1987) Mol Cell Biol 7: 177-184), or quantification of cytokinins in tRNA (Gray et al. (1996) Plant Physiol 110: 431-438, Miyawaki et al. (2006) Proc Natl Acad SCi USA 103(44): 16598-16603).

In addition, SHR polypeptides, when expressed in rice grown under conditions of sub-optimal nutrient availability gives the plants enhanced yield-related traits relative to control plants. SHR polypeptides when expressed in rice grown under non-nutrient limiting conditions gives the plants increased Thousand Kernel Weight (TKW) in plants relative to control plants.

Concerning TCP1 and TCP2, the present invention is illustrated by transforming plants with the nucleic acid sequence represented by SEQ ID NO: 1, encoding the polypeptide sequence of SEQ ID NO: 2 and by transforming plants with the nucleic acid sequence represented by SEQ ID NO: 3, encoding the polypeptide sequence of SEQ ID NO: 4. However, performance of the invention is not restricted to these sequences; the methods of the invention may advantageously be performed using any TCP1-encoding or TCP2-encoding nucleic acid, or using a TCP1 or TCP2 polypeptide as defined herein.

Concerning TCP1 and TCP2, examples of nucleic acids encoding TCP1 and TCP2 polypeptides are given in Example 1 herein. Such nucleic acids are useful in performing the methods of the invention. The amino acid sequences encoded by the nucleic acid sequences given in Example 1 are example sequences of orthologues and paralogues of the TCP 1 polypeptide represented by SEQ ID NO: 2, and the amino acid sequences encoded by the nucleic acid sequences given in Example 1 are example sequences of orthologues and paralogues of the TCP 2 polypeptide represented by SEQ ID NO: 4, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 to SEQ ID NO: 4, the second BLAST would therefore be against *Medicago* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning Epsin-like-sequences, the present invention is illustrated by transforming plants with the nucleic acid sequence represented by SEQ ID NO: 43, encoding the polypeptide sequence of SEQ ID NO: 44. However, performance of the invention is not restricted to these sequences; the methods of the invention may advantageously be performed using any Epsin-like-encoding nucleic acid or Epsin-like polypeptide as defined herein.

Concerning Epsin-like-sequences, examples of nucleic acids encoding Epsin-like polypeptides are given in Table A3 of Example 1 herein. Such nucleic acids are useful in performing the methods of the invention. The amino acid sequences given in Table A3 of Example 1 are example sequences of orthologues and paralogues of the Epsin-like polypeptide represented by SEQ ID NO: 44, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A3 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 43 or SEQ ID NO: 44, the second BLAST would therefore be against *Arabidopsis* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning IPPT, the present invention is illustrated by transforming plants with the nucleic acid sequence represented by SEQ ID NO: 143, encoding the IPPT polypeptide sequence of SEQ ID NO: 144. However, performance of the invention is not restricted to these sequences; the methods of the invention may advantageously be performed using any nucleic acid sequence encoding an IPPT polypeptide as defined herein.

Concerning IPPT, examples of nucleic acid sequences encoding IPPT polypeptides are given in Table A4 of Example 1 herein. Such nucleic acid sequences are useful in performing the methods of the invention. The polypeptide sequences given in Table A4 of Example 1 are example sequences of orthologues and paralogues of the IPPT polypeptide represented by SEQ ID NO: 144, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A4 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 143 or SEQ ID NO: 144, the second BLAST would therefore be against *Synechococcus* sp. PCC 7942 sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning SHR, the present invention is illustrated by transforming plants with the nucleic acid sequence represented by SEQ ID NO: 208, encoding the polypeptide sequence of SEQ ID NO: 209. However, performance of the invention is not restricted to these sequences; the methods of the invention may advantageously be performed using any SHR-encoding nucleic acid or SHR polypeptide as defined herein.

Concerning SHR, examples of nucleic acids encoding SHR polypeptides are given in Table A5 of Example 1 herein. Such nucleic acids are useful in performing the methods of the invention. The amino acid sequences given in Table A5 of Example 1 are example sequences of orthologues and paralogues of the SHR polypeptide represented by SEQ ID NO: 209, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A5 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 208 or SEQ ID NO: 209, the second BLAST would therefore be against *Arabidopsis* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences encoded by the nucleic acid sequences given in table A of Example 1, the terms "homologue" and "derivative" being as defined herein. Also useful in the methods of the invention are nucleic acids encoding homologues and derivatives of orthologues or paralogues of any one of the amino acid sequences encoded by the nucleic acid sequences given in table A of Example 1. Homologues and derivatives useful in the methods of the present invention have substantially the same biological and functional activity as the unmodified protein from which they are derived.

Further nucleic acid variants useful in practising the methods of the invention include portions of nucleic acids encoding TCP1 or TCP2, Epsin-like, IPPT or SHR polypeptides, nucleic acids hybridising to nucleic acids encoding TCP1 or TCP2, Epsin-like, IPPT or SHR polypeptides, splice variants of nucleic acids encoding TCP1 or TCP2, Epsin-like, IPPT or SHR polypeptides, allelic variants of nucleic acids encoding TCP1 or TCP2, Epsin-like, IPPT or SHR polypeptides and variants of nucleic acids encoding TCP1 or TCP2, Epsin-like, IPPT or SHR polypeptides obtained by gene shuffling. The terms hybridising sequence, splice variant, allelic variant and gene shuffling are as described herein.

Nucleic acids encoding TCP1 or TCP2, Epsin-like, or IPPT need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences encoded by the nucleic acid sequences given in table A of Example 1, or a portion of a nucleic acid encoding an orthologue, paralogue or homologue of any of the amino acid sequences encoded by the nucleic acid sequences given in Example 1.

Nucleic acids encoding SHR polypeptides need not be full-length nucleic acids, since performance of the methods of the invention does not rely on the use of full-length nucleic acid sequences. According to the present invention, there is provided a method for enhancing yield-related traits in plants grown under conditions of sub-optimal nutrient availability, comprising introducing and expressing in a plant a portion of any one of the nucleic acid sequences given in Table A5 of Example 1, or a portion of a nucleic acid encoding an orthologue, paralogue or homologue of any of the amino acid sequences given in Table A5 of Example 1. There is also provided a method for increasing TKW in plants grown under non-nutrient limiting conditions, comprising introducing and expressing in a plant a portion of any one of the nucleic acid sequences given in Table A5 of Example 1, or a portion of a nucleic acid encoding an orthologue, paralogue or homologue of any of the amino acid sequences given in Table A5 of Example 1.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Concerning TCP1 or TCP2, portions useful in the methods of the invention, encode a TCP1 or TCP2 polypeptide as defined herein, and have substantially the same biological activity as the amino acid sequences encoded by the nucleic acid sequences given in Example 1. Preferably, the portion is a portion of any one of the nucleic acids given in Example 1, or is a portion of a nucleic acid encoding an orthologue or paralogue of any one of the amino acid sequences encoded by the nucleic acid sequences given in Example 1. Preferably the portion is at least 500, 550, 600, 650, 700, 750, 800, 850, 900, 950, 100, 1050, 1100, 1150, 1200, 1250, 1300, 1350, 1400, 1450, 1500 consecutive nucleotides in length, the consecutive nucleotides being of any one of the nucleic acid sequences given in Example 1, or of a nucleic acid encoding an orthologue or paralogue of any one of the amino acid sequences encoded by the nucleic acid sequences given in Example 1. Most preferably the portion is a portion of the nucleic acid of SEQ ID NO: 1 or SEQ ID NO: 3. Preferably, the portion encodes a fragment of an amino acid sequence which, when used in the construction of a phylogenetic tree, such as the one depicted in FIG. 1 or 2, clusters with the group of TCP1 or TCP2 polypeptides comprising the amino acid sequence represented by SEQ ID NO: 2 or SEQ ID NO: 4 rather than with any other group.

Concerning Epsin-like sequences, portions useful in the methods of the invention, encode an Epsin-like polypeptide as defined herein, and have substantially the same biological activity as the amino acid sequences given in Table A3 of Example 1. Preferably, the portion is a portion of any one of the nucleic acids given in Table A3 of Example 1, or is a portion of a nucleic acid encoding an orthologue or paralogue of any one of the amino acid sequences given in Table A3 of Example 1. Preferably the portion is at least 500, 600, 700, 800, 900, 1000, 1100, 1200, 1300, 1400, 1500, 1600, 1700, 1800, 1850, 1900, 1950, 2000, 2050, 2100, 2150, 2200, 2250, 2300 consecutive nucleotides in length, the consecutive nucleotides being of any one of the nucleic acid sequences given in Table A3 of Example 1, or of a nucleic acid encoding an orthologue or paralogue of any one of the amino acid sequences given in Table A3 of Example 1. Most preferably the portion is a portion of the nucleic acid of SEQ ID NO: 43.

Preferably, the portion encodes a fragment of an amino acid sequence which, when used in the construction of a phylogenetic tree, such as the one depicted in FIG. 3 (Holstein and Oliviusson, Protoplasma 226, 13-21, 2005), clusters with the group of Epsin-like polypeptides comprising the amino acid sequence represented by SEQ ID NO: 44 rather than with any other group.

Concerning IPPT, portions useful in the methods of the invention, encode an IPPT polypeptide as defined herein, and have substantially the same biological activity as the polypeptide sequences given in Table A4 of Example 1. Preferably, the portion is a portion of any one of the nucleic acid sequences given in Table A4 of Example 1, or is a portion of a nucleic acid sequence encoding an orthologue or paralogue of any one of the polypeptide sequences given in Table A4 of Example 1. Preferably the portion is, in increasing order of preference at least 400, 450, 500, 550, 600, 650, 700, 750, 800, 850, 900, 920 or more consecutive nucleotides in length, the consecutive nucleotides being of any one of the nucleic acid sequences given in Table A4 of Example 1, or of a nucleic acid sequence encoding an orthologue or paralogue of any one of the polypeptide sequences given in Table A4 of Example 1. Preferably, the portion is a portion of a nucleic sequence encoding a polypeptide sequence having in increasing order of preference at least 35%, 40%, 45%, 50%, 55%, 60%, 65%, 70%, 75%, 80%, 85%, 90%, 95%, 98%, 99% or more amino acid sequence identity to the IPPT polypeptide as represented by SEQ ID NO: 144 or to any of the polypeptide sequences given in Table A4 herein. Most preferably, the portion is a portion of the nucleic acid sequence of SEQ ID NO: 143.

Concerning SHR, portions useful in the methods of the invention, encode an SHR polypeptide as defined herein, and have substantially the same biological activity as the amino acid sequences given in Table A5 of Example 1. Preferably, the portion is a portion of any one of the nucleic acids given in Table A5 of Example 1, or is a portion of a nucleic acid encoding an orthologue or paralogue of any one of the amino acid sequences given in Table A5 of Example 1. Preferably the portion is at least 1000, 1250, 1500, 1600, 1700 consecutive nucleotides in length, the consecutive nucleotides being of any one of the nucleic acid sequences given in Table A5 of Example 1, or of a nucleic acid encoding an orthologue or paralogue of any one of the amino acid sequences given in Table A5 of Example 1. Most preferably the portion is a portion of the nucleic acid of SEQ ID NO: 208. Preferably, the portion encodes a fragment of an amino acid sequence which, when used in the construction of a GRAS phylogenetic tree, such as the one depicted in FIG. 14, clusters with the group of SHR polypeptides comprising the amino acid sequence represented by SEQ ID NO: 209 rather than with any other group.

Another nucleic acid variant useful in the methods of the invention is a nucleic acid capable of hybridising, under reduced stringency conditions, preferably under stringent conditions, with a nucleic acid encoding a TCP1 or TCP2, or an Epsin-like, or an IPPT, or a SHR polypeptide as defined herein, or with a portion as defined herein.

According to the present invention, there is provided a method for enhancing yield-related traits in plants, comprising introducing and expressing in a plant a nucleic acid capable of hybridizing to any one of the nucleic acids given in table A of Example 1, or comprising introducing and expressing in a plant a nucleic acid capable of hybridising to a nucleic acid encoding an orthologue, paralogue or homologue of an amino acid encoded by any of the nucleic acid sequences given in table A of Example 1.

Concerning TCP1 or TCP2 or an Epsine-like-sequences, hybridising sequences useful in the methods of the invention encode a TCP1 or TCP2 or an Epsine-like polypeptide as defined herein, having substantially the same biological activity as the amino acid sequences encoded by the nucleic acid sequences given in table A of Example 1. Preferably, the hybridising sequence is capable of hybridising to any one of the nucleic acids given in table A of Example 1, or to a portion of any of these sequences, a portion being as defined above, or the hybridising sequence is capable of hybridising to a nucleic acid encoding an orthologue or paralogue of any one of the amino acid sequences encoded by the nucleic acid sequences given in table A of Example 1. Concerning TCP1 or TCP2, most preferably, the hybridising sequence is capable of hybridising to a nucleic acid as represented by SEQ ID NO: 1 or to a portion thereof or SEQ ID NO: 3 or to a portion thereof. Concerning Epsine-like sequences, most preferably, the hybridising sequence is capable of hybridising to a nucleic acid as represented by SEQ ID NO: 43 or to a portion thereof.

Concerning IPPT, hybridising sequences useful in the methods of the invention encode an IPPT polypeptide as defined herein, and have substantially the same biological activity as the polypeptide sequences given in Table A4 of Example 1. Preferably, the hybridising sequence is capable of hybridising to any one of the nucleic acid sequences given in Table A4 of Example 1, or to a portion of any of these sequences, a portion being as defined above, or wherein the hybridising sequence is capable of hybridising to a nucleic acid sequence encoding an orthologue or paralogue of any one of the polypeptide sequences given in Table A4 of Example 1. Preferably, the hybridising sequence is capable of hybridising to a nucleic acid sequence encoding a polypeptide sequence having in increasing order of preference at least 35%, 40%, 45%, 50%, 55%, 60%, 65%, 70%, 75%, 80%, 85%, 90%, 95%, 98%, 99% or more amino acid sequence identity to the IPPT polypeptide as represented by SEQ ID NO: 144 or to any of the polypeptide sequences given in Table A4 herein. Most preferably, the hybridising sequence is capable of hybridising to a nucleic acid sequence as represented by SEQ ID NO: 143 or to a portion thereof.

Another nucleic acid sequence variant useful in the methods of the invention is a splice variant encoding an IPPT polypeptide as defined hereinabove, a splice variant being as defined herein.

Concerning SHR, hybridising sequences useful in the methods of the invention encode an SHR polypeptide as defined herein, having substantially the same biological activity as the amino acid sequences given in table A of Example 1. Preferably, the hybridising sequence is capable of hybridising to any one of the nucleic acids given in table A of Example 1, or to a portion of any of these sequences, a portion being as defined above, or the hybridising sequence is capable of hybridising to a nucleic acid encoding an orthologue or paralogue of any one of the amino acid sequences given in table A of Example 1. Most preferably, the hybridising sequence is capable of hybridising to a nucleic acid as represented by SEQ ID NO: 208 or to a portion thereof. Preferably, the hybridising sequence encodes a polypeptide with an amino acid sequence which, when full-length and used in the construction of a GRAS phylogenetic tree, such as the one depicted in FIG. 14, clusters with the group of SHR polypeptides comprising the amino acid sequence represented by SEQ ID NO: 209 rather than with any other group.

Concerning TCP1 or TCP2, preferably, the hybridising sequence encodes a polypeptide with an amino acid sequence which, when full-length and used in the construction of a phylogenetic tree, such as the one depicted in FIG. 1 or 2, clusters with the group of TCP1 or TCP2 polypeptides comprising the amino acid sequence represented by SEQ ID NO: 2 or 4 rather than with any other group.

Concerning Epsin-like-sequences, preferably, the hybridising sequence encodes a polypeptide with an amino acid sequence which, when full-length and used in the construction of a phylogenetic tree, such as the one depicted in FIG. 3 (Holstein and Oliviusson, Protoplasma 226, 13-21, 2005), clusters with the group of Epsin-like polypeptides comprising the amino acid sequence represented by SEQ ID NO: 44 rather than with any other group.

Another nucleic acid variant useful in the methods of the invention is a splice variant encoding a TCP1 or TCP2 or an Epsin-like, or a SHR polypeptide as defined hereinabove, a splice variant being as defined herein.

According to the present invention, there is provided a method for enhancing yield-related traits in plants, comprising introducing and expressing in a plant a splice variant of any one of the nucleic acid sequences given in table A of Example 1, or a splice variant of a nucleic acid encoding an orthologue, paralogue or homologue of any of the amino acid sequences encoded by the nucleic acid sequences given in table A of Example 1.

Concerning SHR, there is also provided a method for increasing TKW in plants, comprising introducing and expressing in a plant a splice variant of any one of the nucleic acid sequences given in Table A5 of Example 1, or a splice variant of a nucleic acid encoding an orthologue, paralogue or homologue of any of the amino acid sequences given in Table A5 of Example 1 and growing the plants under non-nutrient limiting conditions.

Concerning TCP1 or TCP2, preferred splice variants are splice variants of a nucleic acid represented by SEQ ID NO: 1 or 3, or a splice variant of a nucleic acid encoding an orthologue or paralogue of SEQ ID NO: 2 or 4. Preferably, the amino acid sequence encoded by the splice variant, when used in the construction of a phylogenetic tree, such as the one depicted in FIG. 1 or 2, clusters with the group of TCP1 or TCP2 polypeptides comprising the amino acid sequence represented by SEQ ID NO: 2 or 4 rather than with any other group.

Concerning Epsin-like sequences, preferred splice variants are splice variants of a nucleic acid represented by SEQ ID NO: 43, or a splice variant of a nucleic acid encoding an orthologue or paralogue of SEQ ID NO: 44. Preferably, the amino acid sequence encoded by the splice variant, when used in the construction of a phylogenetic tree, such as the one depicted in FIG. 3 (Holstein and Oliviusson, Protoplasma 226, 13-21, 2005), clusters with the group of Epsin-like polypeptides comprising the amino acid sequence represented by SEQ ID NO: 44 rather than with any other group.

Concerning IPPT, preferred splice variants are splice variants of a nucleic acid sequence represented by SEQ ID NO: 143, or a splice variant of a nucleic acid sequence encoding an orthologue or paralogue of SEQ ID NO: 144. Preferably, the splice variant is a splice variant of a nucleic acid sequence encoding a polypeptide sequence having in increasing order of preference at least 35%, 40%, 45%, 50%, 55%, 60%, 65%, 70%, 75%, 80%, 85%, 90%, 95%, 98%, 99% or more amino acid sequence identity to the IPPT polypeptide as represented by SEQ ID NO: 144 or to any of the polypeptide sequences given in Table A4 herein.

Concerning SHR, preferred splice variants are splice variants of a nucleic acid represented by SEQ ID NO: 208, or a splice variant of a nucleic acid encoding an orthologue or paralogue of SEQ ID NO: 209. Preferably, the amino acid sequence encoded by the splice variant, when used in the construction of a GRAS phylogenetic tree, such as the one depicted in FIG. 14, clusters with the group of SHR polypeptides comprising the amino acid sequence represented by SEQ ID NO: 209 rather than with any other group.

Another nucleic acid variant useful in performing the methods of the invention is an allelic variant of a nucleic acid encoding a TCP1 or TCP2 or an Epsin-like, or an IPPT, or an SHR polypeptide as defined hereinabove, an allelic variant being as defined herein.

According to the present invention, there is provided a method for enhancing yield-related traits in plants, comprising introducing and expressing in a plant an allelic variant of any one of the nucleic acids given in table A of Example 1, or comprising introducing and expressing in a plant an allelic variant of a nucleic acid encoding an orthologue, paralogue or homologue of any of the amino acid sequences encoded by the nucleic acid sequences given in table A of Example 1.

Concerning IPPT, according to the present invention, there is provided a method for increasing yield-related traits, comprising introducing and expressing in the seeds of a plant, an allelic variant of any one of the nucleic acid sequences given in table A of Example 1, or comprising introducing and expressing in the seeds of a plant, an allelic variant of a nucleic acid sequence encoding an orthologue, paralogue or homologue of any of the polypeptide sequences given in table A of Example 1.

Concerning SHR, there is also provided a method for increasing TKW in plants, comprising introducing and expressing in a plant an allelic variant of any one of the nucleic acids given in Table A of Example 1, or comprising introducing and expressing in a plant an allelic variant of a nucleic acid encoding an orthologue, paralogue or homologue of any of the amino acid sequences given in Table A of Example 1, and growing plants under non-nutrient limiting conditions.

Concerning TCP1 or TCP2, the allelic variants useful in the methods of the present invention have substantially the same biological activity as the TCP1 or TCP2 polypeptide of SEQ ID NO: 2 or 4 and any of the amino acids encoded by the nucleic acid sequences given in Example 1. Allelic variants exist in nature, and encompassed within the methods of the present invention is the use of these natural alleles. Preferably, the allelic variant is an allelic variant of SEQ ID NO: 1 or 3 or an allelic variant of a nucleic acid encoding an orthologue or paralogue of SEQ ID NO: 2 or 4. Preferably, the amino acid sequence encoded by the allelic variant, when used in the construction of a phylogenetic tree, such as the one depicted in FIG. 1 or 2, clusters with the TCP1 or TCP2 polypeptides comprising the amino acid sequence represented by SEQ ID NO: 2 or 4 TCP1 or TCP2 rather than with any other group.

Concerning Epsin-like sequences, the allelic variants useful in the methods of the present invention have substantially the same biological activity as the Epsin-like polypeptide of SEQ ID NO: 44 and any of the amino acids depicted in Table A3 of Example 1. Allelic variants exist in nature, and encompassed within the methods of the present invention is the use of these natural alleles. Preferably, the allelic variant is an allelic variant of SEQ ID NO: 43 or an allelic variant of a nucleic acid encoding an orthologue or paralogue of SEQ ID NO: 44. Preferably, the amino acid sequence encoded by the allelic variant, when used in the construction of a phylogenetic tree, such as the one depicted in FIG. 3 (Holstein and Oliviusson, Protoplasma 226, 13-21, 2005), clusters with the group of Epsin-like polypeptides comprising the amino acid sequence represented by SEQ ID NO: 44 rather than with any other group.

Concerning IPPT, the allelic variants useful in the methods of the present invention have substantially the same biological activity as the IPPT polypeptide of SEQ ID NO: 144 and any of the polypeptide sequences depicted in Table A4 of Example 1. Allelic variants exist in nature, and encompassed within the methods of the present invention is the use of these natural alleles. Preferably, the allelic variant is an allelic variant of SEQ ID NO: 143 or an allelic variant of a nucleic acid sequence encoding an orthologue or paralogue of SEQ ID NO: 144. Preferably, the allelic variant is an allelic variant of a polypeptide sequence having in increasing order of preference at least 35%, 40%, 45%, 50%, 55%, 60%, 65%, 70%, 75%, 80%, 85%, 90%, 95%, 98%, 99% or more amino acid sequence identity to the IPPT polypeptide as represented by SEQ ID NO: 144 or to any of the polypeptide sequences given in Table A4 herein.

Concerning SHR, the allelic variants useful in the methods of the present invention have substantially the same biological activity as the SHR polypeptide of SEQ ID NO: 209 and any of the amino acids depicted in Table A5 of Example 1. Allelic variants exist in nature, and encompassed within the methods of the present invention is the use of these natural alleles. Preferably, the allelic variant is an allelic variant of SEQ ID NO: 208 or an allelic variant of a nucleic acid encoding an orthologue or paralogue of SEQ ID NO: 209. Preferably, the amino acid sequence encoded by the allelic variant, when used in the construction of a GRAS phylogenetic tree, such as the one depicted in FIG. 14, clusters with the SHR polypeptides comprising the amino acid sequence represented by SEQ ID NO: 209 rather than with any other group.

Gene shuffling or directed evolution may also be used to generate variants of nucleic acids encoding TCP1 or TCP2 or an Epsin-like, or IPPT, or SHR polypeptides as defined above; the term "gene shuffling" being as defined herein.

According to the present invention, there is provided a method for enhancing yield-related or for increasing TKW traits in plants, comprising introducing and expressing in a plant a variant of any one of the nucleic acid sequences given in table A of Example 1, or comprising introducing and expressing in a plant a variant of a nucleic acid encoding an orthologue, paralogue or homologue of any of the amino acid sequences encoded by the nucleic acid sequences given in table A of Example 1, which variant nucleic acid is obtained by gene shuffling, and growing the plants under non-nutrient limiting conditions.

Concerning TCP1 or TCP2, preferably, the amino acid sequence encoded by the variant nucleic acid obtained by gene shuffling, when used in the construction of a phylogenetic tree such as the one depicted in FIG. 1 or 2, clusters with the group of TCP1 or TCP2 polypeptides comprising the amino acid sequence represented by SEQ ID NO: 2 or 4 rather than with any other group.

Concerning Epsin-like sequences, preferably, the amino acid sequence encoded by the variant nucleic acid obtained by gene shuffling, when used in the construction of a phylogenetic tree such as the one depicted in FIG. 3 (Holstein and Oliviusson, Protoplasma 226, 13-21, 2005), clusters with the group of Epsin-like polypeptides comprising the amino acid sequence represented by SEQ ID NO: 44 rather than with any other group.

Concerning IPPT, preferably, the variant nucleic acid sequence obtained by gene shuffling encodes a polypeptide sequence having in increasing order of preference at least 35%, 40%, 45%, 50%, 55%, 60%, 65%, 70%, 75%, 80%, 85%, 90%, 95%, 98%, 99% or more amino acid sequence identity to the IPPT polypeptide as represented by SEQ ID NO: 144 or to any of the polypeptide sequences given in Table A4 herein.

Concerning SHR, preferably, the amino acid sequence encoded by the variant nucleic acid obtained by gene shuffling, when used in the construction of a GRAS phylogenetic tree such as the one depicted in FIG. 14, clusters with the group of SHR polypeptides comprising the amino acid sequence represented by SEQ ID NO: 209 rather than with any other group. Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding TCP1 or TCP2 polypeptides may be derived from any natural or artificial source. The nucleic acid may be modified from its native form in composition and/or genomic environment through deliberate human manipulation. Preferably the TCP1 or TCP2 polypeptide-encoding nucleic acid is from a plant, further preferably from a dicotyledonous plant, more preferably from the family Medicago, most preferably the nucleic acid is from *Medicago sativa* or *Medicago truncatula*.

Nucleic acids encoding Epsin-like polypeptides may be derived from any natural or artificial source. The nucleic acid may be modified from its native form in composition and/or genomic environment through deliberate human manipulation. Preferably the Epsin-like polypeptide-encoding nucleic acid is from a plant, further preferably from a dicotyledonous plant, more preferably from the family Brassicaceae, most preferably the nucleic acid is from *Arabidopsis thaliana*.

Nucleic acid sequences encoding IPPT polypeptides may be derived from any natural or artificial source. The nucleic acid sequence may be modified from its native form in composition and/or genomic environment through deliberate human manipulation. The nucleic acid sequence encoding an IPPT polypeptide is from the Procaryota domain, preferably from Cyanobacteria, further preferably from the orders Nostocales, Oscillatoriales, Chroococcales, Prochlorales, Gloeobacterales, Pleurocapsales, Stigonematales. More preferably, the nucleic acid sequence encoding an IPPT polypeptide is from *Nostoc, Trichodesmium, Anabaena, Acaryochloris, Microcystis, Thermosynechococcus, Synechococcus, Prochlorococcus, Gloeobacter, Synechocystis*. Most preferably, the nucleic acid sequence encoding an IPPT polypeptide is from *Synechococcus* species, in particular from *Synechococcus* PCC 7942.

Nucleic acids encoding SHR polypeptides may be derived from any natural or artificial source. The nucleic acid may be modified from its native form in composition and/or genomic environment through deliberate human manipulation. Preferably the SHR polypeptide-encoding nucleic acid is from a plant, further preferably from a dicotyledonous plant, more preferably from the family Brassicaceae, most preferably the nucleic acid is from *Arabidopsis thaliana*.

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase in biomass (weight) of one or more parts of a plant, which may include aboveground (harvestable) parts and/or (harvestable) parts below ground. In particular, such harvestable parts are vegetative plant parts and/or seeds, and performance of the methods of the invention results in plants having increased seed yield relative to the seed yield of control plants.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression in a plant of a nucleic acid encoding a TCP1 or TCP2 or an Epsin-like or an IPPT, or an SHR polypeptide as defined herein.

Since the transgenic plants according to the present invention have increased yield, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding a TCP1 or TCP2 or an Epsin-like, or an IPPT polypeptide as defined herein. Additionally, a method is provided for increasing the growth rate of plants, which method comprises modulating expression in a plant of a nucleic acid encoding a SHR polypeptide as defined herein, and growing the plants under conditions of sub-optimal nutrient availability. Enhanced yield-related traits are obtained by performance of the methods of the invention and growing plants under conditions of nutrient deficiency, particularly under conditions of nitrogen deficiency. Nutrient deficiency may result from a lack of nutrients such as nitrogen, phosphates and other phosphorous-containing compounds, potassium, calcium, cadmium, magnesium, manganese, iron and boron, amongst others. According to a preferred feature of the present invention, there is provided a method for enhancing yield-related traits in plants, comprising modulating expression in a plant of a nucleic acid encoding a SHR polypeptide and growing plants under conditions of nitrogen deficiency.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes, and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location.

Concerning IPPT, since diverse environmental stresses activate similar pathways, the exemplification of the present invention with drought stress should not be seen as a limitation to drought stress, but more as a screen to indicate the involvement of IPPT polypeptides as defined above, in increasing yield-related traits relative to control plants grown in comparable stress conditions, in abiotic stresses in general.

Concerning IPPT, the term "abiotic stress" as defined herein is taken to mean any one or more of: water stress (due to drought or excess water), anaerobic stress, salt stress, temperature stress (due to hot, cold or freezing temperatures), chemical toxicity stress and oxidative stress. According to one aspect of the invention, the abiotic stress is an osmotic stress, selected from water stress, salt stress, oxidative stress and ionic stress. Preferably, the water stress is drought stress. The term salt stress is not restricted to common salt (NaCl), but may be any stress caused by one or more of: NaCl, KCl, LiCl, MgCl2, CaCl2, amongst others.

Performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding a TCP1 or TCP2 or an Epsin-like polypeptide.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding a TCP1 or TCP2 or an Epsin-like polypeptide. Nutrient deficiency may result from a lack of nutrients such as nitrogen, phosphates and other phosphorous-containing compounds, potassium, calcium, cadmium, magnesium, manganese, iron and boron, amongst others.

Concerning IPPT, performance of the methods of the invention gives plants having increased yield-related traits, under abiotic stress conditions relative to control plants grown in comparable stress conditions. Therefore, according to the present invention, there is provided a method for increasing yield-related traits, in plants grown under abiotic stress conditions, which method comprises increasing expression in the seeds of a plant, of a nucleic acid sequence encoding an IPPT polypeptide. According to one aspect of the invention, the abiotic stress is an osmotic stress, selected from one or more of the following: water stress, salt stress, oxidative stress and ionic stress.

Furthermore, concerning IPPT, performance of the methods of the invention gives plants grown under conditions of reduced nutrient availability, particularly under conditions of reduced nitrogen availability, having increased yield-related traits relative to control plants grown under comparable conditions. Therefore, according to the present invention, there is provided a method for increasing yield-related traits in plants grown under conditions of reduced nutrient availability, preferably reduced nitrogen availability, which method comprises increasing expression in the seeds of a plant, of a nucleic acid sequence encoding an IPPT polypeptide. Reduced nutrient availability may result from a deficiency or excess of nutrients such as nitrogen, phosphates and other phosphorous-containing compounds, potassium, calcium, cadmium, magnesium, manganese, iron and boron, amongst others. Preferably, reduced nutrient availability is reduced nitrogen availability.

Another example of abiotic environmental stress is the reduced availability of one or more nutrients that need to be assimilated by the plants for growth and development. Because of the strong influence of nutrition utilization efficiency on plant yield and product quality, a huge amount of fertilizer is poured onto fields to optimize plant growth and quality. Productivity of plants ordinarily is limited by three primary nutrients, phosphorous, potassium and nitrogen, which is usually the rate-limiting element in plant growth of these three. Therefore the major nutritional element required for plant growth is nitrogen (N). It is a constituent of numerous important compounds found in living cells, including amino acids, proteins (enzymes), nucleic acids, and chlorophyll. 1.5% to 2% of plant dry matter is nitrogen and approximately 16% of total plant protein. Thus, nitrogen availability is a major limiting factor for crop plant growth and production (Frink et al. (1999) Proc Natl Acad Sci USA 96(4): 1175-1180), and has as well a major impact on protein accumulation and amino acid composition. Therefore, of great interest are crop plants with increased yield-related traits, when grown under nitrogen-limiting conditions.

The present invention encompasses plants or parts thereof (including seeds) or cells thereof obtainable by the methods according to the present invention. The plants or parts thereof or cells thereof comprise a nucleic acid transgene encoding a TCP1 or TCP2 or an Epsin-like, or an SHR polypeptide as defined above. Concerning IPPT, the plants or parts thereof or cells thereof comprise a nucleic acid transgene encoding an IPPT polypeptide as defined above, operably linked to a seed-specific promoter.

The invention also provides genetic constructs and vectors to facilitate introduction and/or expression in plants of nucleic acids encoding TCP1 or TCP2 or Epsin-like, or IPPT, or SHR polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding a TCP1 or TCP2 or an Epsin-like, or an IPPT, or an SHR polypeptide as defined above;
(b) one or more control sequences capable of driving expression of the nucleic acid sequence of (a); and optionally
(c) a transcription termination sequence.

Preferably, the nucleic acid encoding a TCP1 or TCP2 or an Epsin-like, or an IPPT, or SHR polypeptide is as defined above. The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to drive expression of the nucleic acid sequence. A constitutive promoter is particularly useful in the methods. Preferably the constitutive promoter is also a ubiquitous promoter. Concerning IPPT, a seed-specific promoter is particularly useful in the methods. Other organ-specific promoters, for example for preferred expression in leaves, stems, tubers, meristems, are useful in performing the methods of the invention. Developmentally-regulated promoters are also useful in performing the methods of the invention See the "Definitions" section herein for definitions of the various promoter types. See the "Definitions" section herein for definitions of the various promoter types.

It should be clear that the applicability of the present invention is not restricted to the TCP1 or TCP2 polypeptide-encoding nucleic acid represented by SEQ ID NO: 1 or 3, nor is the applicability of the invention restricted to expression of a TCP1 or TCP2 polypeptide-encoding nucleic acid when driven by a constitutive promoter.

Concerning TCP1 or TCP2, the constitutive promoter is preferably a GOS2 promoter, preferably a GOS2 promoter from rice. Further preferably the constitutive promoter is represented by a nucleic acid sequence substantially similar to SEQ ID NO: 5, most preferably the constitutive promoter is as represented by SEQ ID NO: 5 (See Table 2b in the "Definitions" section herein for further examples of constitutive promoters). According to another preferred embodiment, the constitutive promoter is preferably a High Mobility Group Protein (HMGP) promoter. Further preferably the constitutive promoter is represented by a nucleic acid sequence substantially similar to SEQ ID NO: 6, most preferably the constitutive promoter is as represented by SEQ ID NO: 6.

It should also be clear that the applicability of the present invention is not restricted to the Epsin-like polypeptide-encoding nucleic acid represented by SEQ ID NO: 43, nor is the applicability of the invention restricted to expression of an Epsin-like polypeptide-encoding nucleic acid when driven by a constitutive promoter.

Furthermore, it should be clear that the applicability of the present invention is not restricted to a nucleic acid sequence encoding the IPPT polypeptide, as represented by SEQ ID NO: 143, nor is the applicability of the invention restricted to expression of an IPPT polypeptide-encoding nucleic acid sequence when driven by a seed-specific promoter.

Also, it should be clear that the applicability of the present invention is not restricted to the SHR polypeptide-encoding nucleic acid represented by SEQ ID NO: 208, nor is the applicability of the invention restricted to expression of a SHR polypeptide-encoding nucleic acid when driven by a constitutive promoter.

Concerning Epsin-like sequences, the constitutive promoter is preferably a GOS2 promoter, preferably a GOS2 promoter from rice. Further preferably the constitutive promoter is represented by a nucleic acid sequence substantially similar to SEQ ID NO: 45, most preferably the constitutive promoter is as represented by SEQ ID NO: 45. See Table 2 in the "Definitions" section herein for further examples of constitutive promoters.

Concerning IPPT, preferably, one of the control sequences of a construct is a seed-specific promoter. An example of a seed-specific promoter is a dehydrin promoter, preferably a rice dehydrin promoter, more preferably a dehydrin promoter as represented by SEQ ID NO: 204. Alternatively, the seed-specific promoter is a proteinase inhibitor promoter, preferably a rice proteinase inhibitor promoter, more preferably a proteinase inhibitor promoter as represented by SEQ ID NO: 205.

Optionally, one or more terminator sequences may be used in the construct introduced into a plant. Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

The invention also provides a method for the production of transgenic plants having enhanced yield-related traits relative to control plants, comprising introduction and expression in a plant of any nucleic acid encoding a TCP1 or TCP2 or an Epsin-like polypeptide as defined hereinabove.

The invention also provides a method for the production of transgenic plants having enhanced yield-related traits relative to control plants, comprising introduction and expression in a plant of any nucleic acid encoding an SHR polypeptide as defined hereinabove and growing the plants under conditions of sub-optimal nutrient availability.

More specifically, the present invention provides a method for the production of transgenic plants having increased enhanced yield-related traits, particularly increased (seed) yield, which method comprises:
(i) introducing and expressing in a plant or plant cell a TCP1 or TCP2 polypeptide-encoding nucleic acid; and
(ii) cultivating the plant cell under conditions promoting plant growth and development.

The nucleic acid of (i) may be any of the nucleic acids capable of encoding a TCP1 or TCP2 polypeptide as defined herein.

Concerning Epsin-like sequences, the present invention provides a method for the production of transgenic plants having increased enhanced yield-related traits, particularly increased biomass and/or increased seed yield, which method comprises:
(i) introducing and expressing in a plant or plant cell an Epsin-like polypeptide-encoding nucleic acid; and
(ii) cultivating the plant cell under conditions promoting plant growth and development.

The nucleic acid of (i) may be any of the nucleic acids capable of encoding an Epsin-like polypeptide as defined herein.

In another embodiment, the invention provides a method for the production of transgenic plants having increased yield-related traits relative to control plants, comprising introduction and expression in the seeds of a plant, of any nucleic acid sequence encoding an IPPT polypeptide as defined hereinabove.

Concerning IPPT, more specifically, the present invention provides a method for the production of transgenic plants having increased yield-related traits relative to control plants, which method comprises:
  (i) introducing and expressing in a plant, plant part, or plant cell a nucleic acid sequence encoding an IPPT polypeptide, under the control of seed-specific promoter; and
  (ii) cultivating the plant cell, plant part or plant under conditions promoting plant growth and development.

The nucleic acid sequence of (i) may be any of the nucleic acid sequences capable of encoding an IPPT polypeptide as defined herein.

In yet another embodiment, the present invention provides a method for the production of transgenic plants having enhanced yield-related traits, particularly increased (seed) yield, which method comprises:
  (i) introducing and expressing in a plant or plant cell an SHR polypeptide-encoding nucleic acid; and
  (ii) cultivating the plant cell under conditions of sub-optimal nutrient availability.

Concerning SHR, the invention also provides a method for the production of transgenic plants having increased TKW relative to control plants, comprising introduction and expression in a plant of any nucleic acid encoding an SHR polypeptide as defined hereinabove, and growing the plants under non-nutrient limiting conditions. More specifically, the present invention provides a method for the production of transgenic plants having increased TKW, which method comprises:
  (i) introducing and expressing in a plant or plant cell an SHR polypeptide-encoding nucleic acid; and
  (ii) cultivating the plant cell under non-nutrient limiting conditions.

The nucleic acid of (i) may be any of the nucleic acids capable of encoding an SHR polypeptide as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding a TCP1 or TCP2, or an Epsin-like, or an SHR polypeptide as defined hereinabove. Preferred host cells according to the invention are plant cells. Concerning IPPT, the invention also includes host cells containing an isolated nucleic acid sequence encoding an IPPT polypeptide as defined hereinabove, operably linked to a seed-specific promoter. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, cotton, tomato, potato and tobacco. Further preferably, the plant is a monocotyledonous plant. Examples of monocotyledonous plants include sugarcane. More preferably the plant is a cereal.

Examples of cereals include rice, maize, wheat, barley, millet, rye, triticale, sorghum and oats.

The invention also extends to harvestable parts of a plant such as, but not limited to seeds, leaves, fruits, flowers, stems, roots, rhizomes, tubers and bulbs. The invention furthermore relates to products derived, preferably directly derived, from a harvestable part of such a plant, such as dry pellets or powders, oil, fat and fatty acids, starch or proteins.

Concerning IPPT, the invention also extends to harvestable parts of a plant comprising an isolated nucleic acid sequence encoding an IPPT (as defined hereinabove) operably linked to a seed-specific promoter, such as, but not limited to seeds, leaves, fruits, flowers, stems, rhizomes, tubers and bulbs. The invention furthermore relates to products derived, preferably directly derived, from a harvestable part of such a plant, such as dry pellets or powders, oil, fat and fatty acids, starch or proteins. Methods for increasing expression of nucleic acid sequences or genes, or gene products, are well documented in the art and examples are provided in the definitions section.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding a TCP1 or TCP2 or an Epsin-like, or an SHR polypeptide is by introducing and expressing in a plant a nucleic acid encoding a TCP1 or TCP2 or an Epsin-like, or an SHR polypeptide; or a preferred method for increasing expression of a nucleic acid sequence encoding an IPPT polypeptide is by introducing and expressing in the seeds of a plant, a nucleic acid sequence encoding an IPPT polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The present invention also encompasses use of nucleic acids encoding TCP1 or TCP2 or an Epsin-like, or an SHR polypeptides as described herein and use of these TCP1 or TCP2 or an Epsin-like, or an SHR polypeptides in enhancing any of the aforementioned yield-related traits in plants. The present invention also encompasses use of nucleic acid sequences encoding IPPT polypeptides as described herein and use of these IPPT polypeptides in increasing any of the aforementioned yield-related traits in plants, under normal growth conditions, under abiotic stress growth (preferably osmotic stress growth conditions) conditions, and under growth conditions of reduced nutrient availability, preferably under conditions of reduced nitrogen availability.

Nucleic acids encoding TCP1 or TCP2 or an Epsin-like, or an IPPT, or an SHR polypeptide described herein, or the TCP1 or TCP2 or the Epsin-like, or the IPPT, or an SHR polypeptides themselves, may find use in breeding programmes in which a DNA marker is identified which may be genetically linked to a TCP1 or TCP2 or an Epsin-like, or an IPPT, or an SHR polypeptide-encoding gene. The nucleic acids/genes, or the TCP1 or TCP2 or the Epsin-like, or the IPPT, or an SHR polypeptides themselves may be used to define a molecular marker. This DNA or protein marker may then be used in breeding programmes to select plants having enhanced yield-related traits, or increased TKW as defined hereinabove in the methods of the invention.

Allelic variants of a TCP1 or TCP2 or an Epsin-like, or an SHR polypeptide-encoding nucleic acid/gene may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Allelic variants of a gene/nucleic acid sequence encoding an IPPT polypeptide may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield-related traits. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding TCP1 or TCP2 or Epsin-like, or an IPPT, or an SHR polypeptides may also be used as probes for genetically and physically mapping the genes that they are a part of, and as markers for traits linked to those genes. Such information may be useful in plant breeding in order to develop lines with desired phenotypes. Such use of TCP1 or TCP2 or an Epsin-like, or an IPPT, or an SHR polypeptide-encoding nucleic acids requires only a nucleic acid sequence of at least 15 nucleotides in length. The TCP1 or TCP2 or an IPPT, or the Epsin-like, or an SHR polypeptide-encoding nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the TCP1 or TCP2 or the Epsin-like, or an IPPT, or an SHR-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the TCP1 or TCP2 or the Epsin-like, or an IPPT, or an SHR polypeptide-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, tolerance to herbicides, insecticides, traits modifying various architectural features and/or biochemical and/or physiological features.

DESCRIPTION OF FIGURES

The present invention will now be described with reference to the following figures in which:

FIG. 3 represents the domain structure of SEQ ID NO: 44 with the ENTH domain as identified in SMART indicated in bold and the conserved motifs 1 to 5 underlined.

FIG. 4 represents a multiple alignment of various Epsin-like protein sequences. The database accession numbers are used as identifiers

FIG. 7 details examples of sequences useful in performing the methods according to the present invention.

FIG. 12 details examples of sequences useful in performing the methods according to the present invention.

FIG. 17 details examples of sequences useful in performing the methods according to the present invention.

Figure 1:
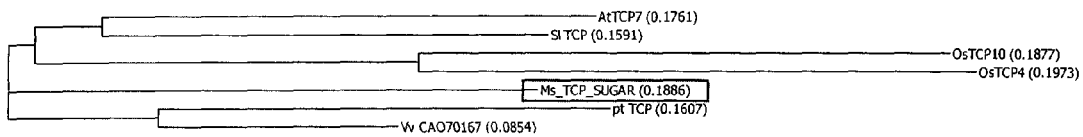
FIG. 1 is a multiple alignment of TCP1 polypeptides with the TCP domain and Domain A, B and C boxed.
Figure 2:
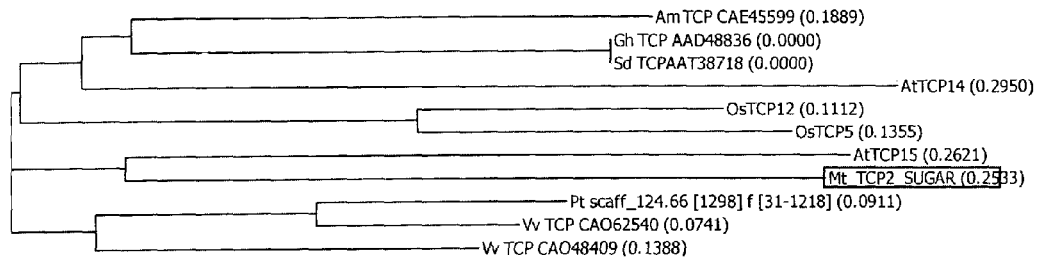
FIG. 2 is a multiple alignment of TCP2 polypeptides with the TCP domain and Domains 1, 2, 3, 4 and 5 boxed.
Figure 5:
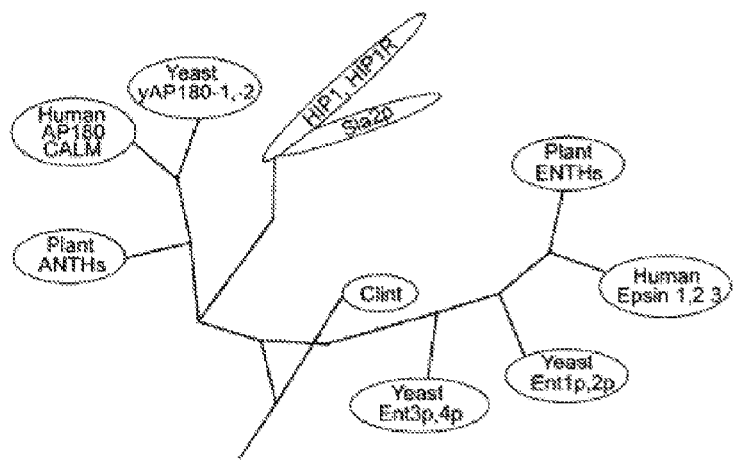
FIG. 5 shows a phylogenetic tree of eukaryotic proteins comprising an ENTH or ANTH domain (Holstein and Oliviusson 2005). The amino-terminal part of the proteins (200 amino acids) were aligned using ClustalW 1.82 and the output was used in DrawTree (PHYLIP package). SEQ ID NO: 44 clusters in the group of the plant ENTHs.
Figure 6:
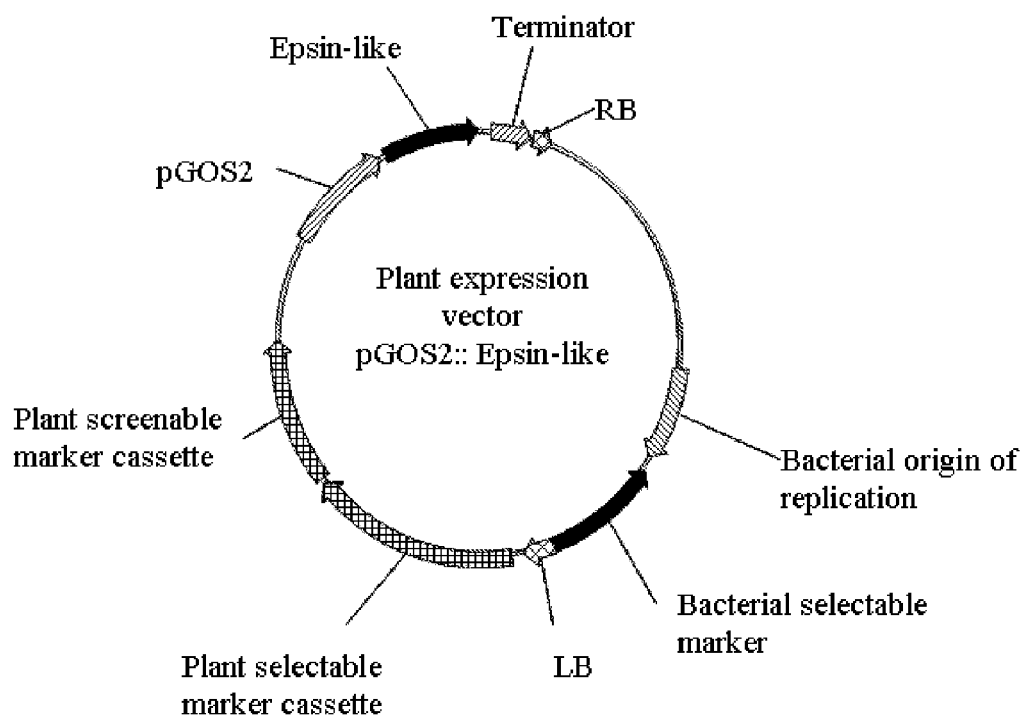
FIG. 6 represents the binary vector for increased expression in *Oryza sativa* of an Epsin-like-encoding nucleic acid under the control of a rice GOS2 promoter (pGOS2)
Figure 8:
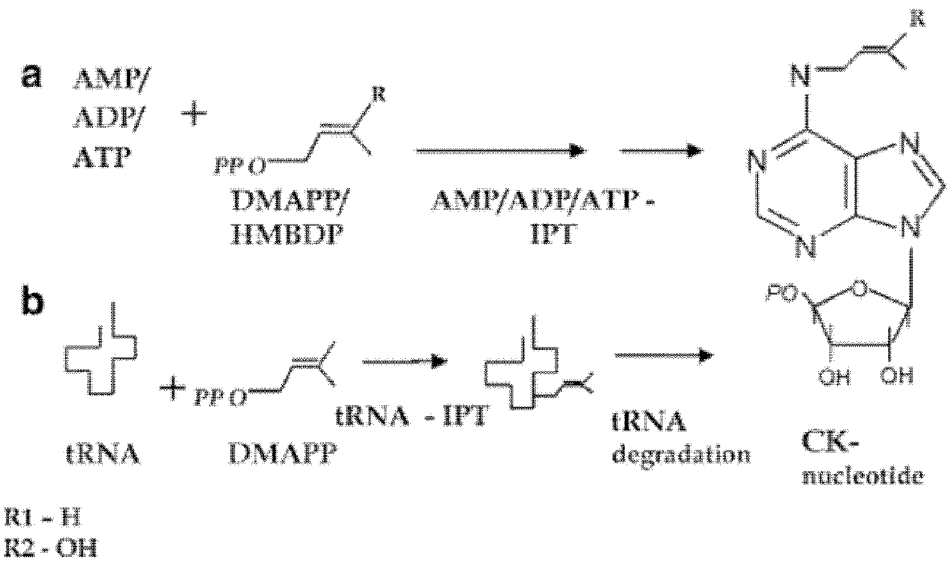
FIG. 8 schematically represents the two major cytokinin biosynthetic routes: (a) the adenylate-IPT route, using AMP, ADP, or ATP, and DMAPP or HMBDP, and (b) the tRNA-IPT route using tRNA and DMAPP. According to Yevdakova and von Schwartzenberg (2007) Planta 226:683-695.
Figure 9:
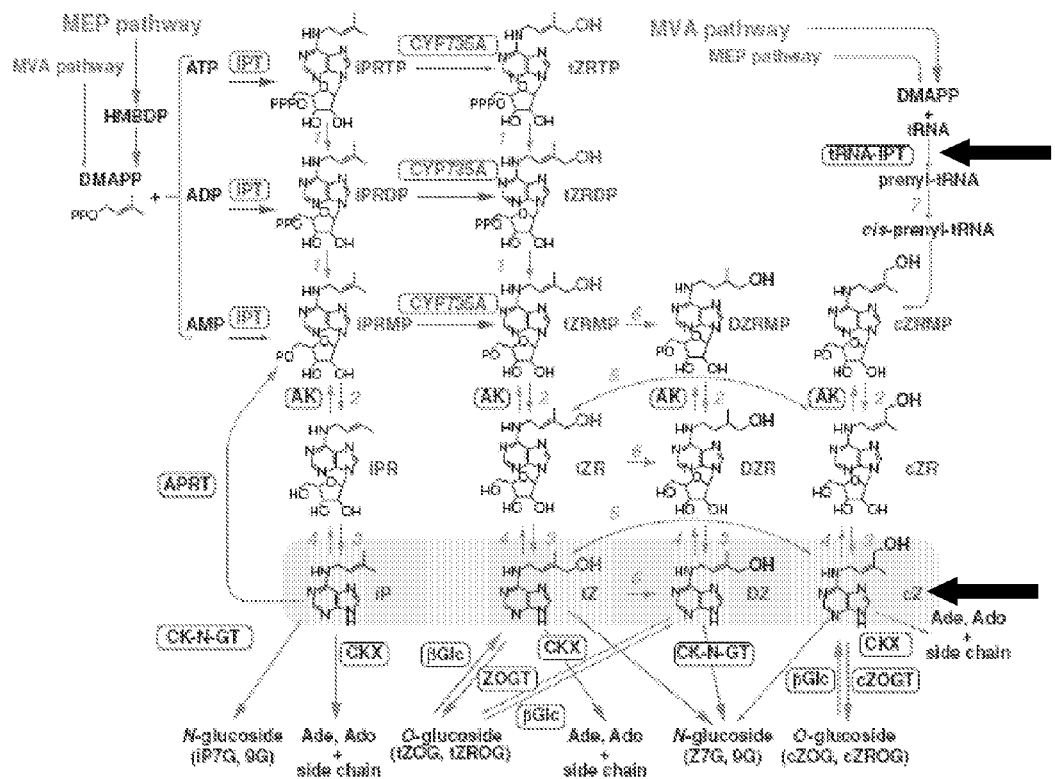
FIG. 9 shows a detailed model of isoprenoid cytokinin biosynthesis pathways, according to Sakakibara (2006) Annu Rev Plant Biol 57. 431-449. The tRNA-IPT is indicated by a black arrow in the top right corner, the specific final cytokinin product (cZ) of that route is also indicated by a black arrow in the bottom right corner.
Figure 10:
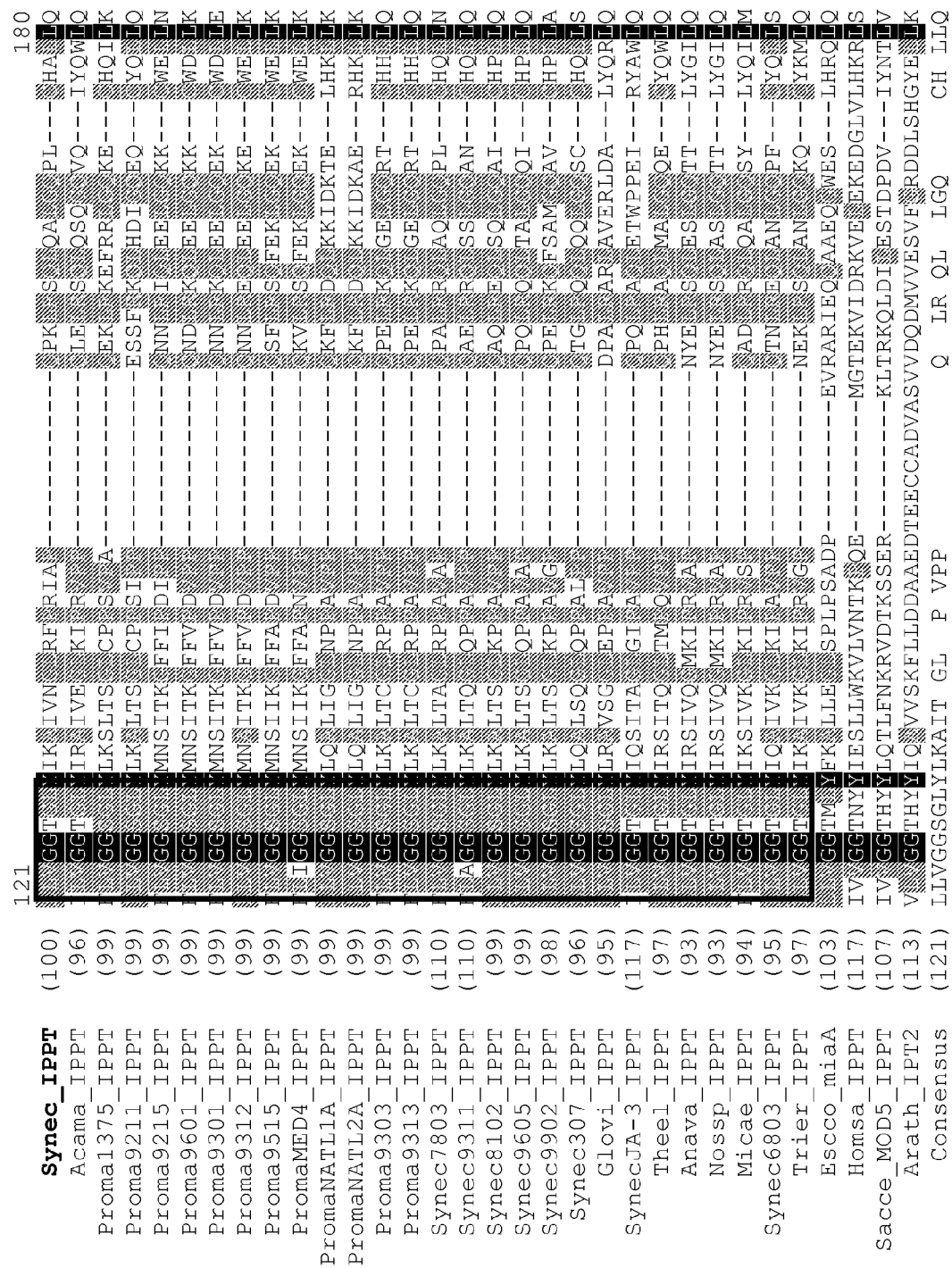
FIG. 10 shows an AlignX (from Vector NTI 10.3, Invitrogen Corporation) multiple sequence alignment of the IPPT polypeptides from Table A4. The N-terminal ATP/GTP-binding site motif A (P-loop) as represented by SEQ ID NO: 199, the Conserved motif I DSR(Q/L)(V/L/I) as represented by SEQ ID NO: 200, the Conserved motif II (N/D/S/T)(I/V) GTAKP(T/S) as represented by SEQ ID NO: 201, the Conserved motif III L(V/A/I)GG(S/T)GLY as represented by SEQ ID NO:202, and the Conserved motif IV F/Y/L)AK(R/K/Q)Q(R/K/M)TWFR, are boxed. The putative zinc finger motif C2H2 (C-X2-C-X(12,18)-H-X5-H found in eukaryotic tRNA-IPTs is marked with a bracket, and the conserved Cys and His residues therein are boxed.
Figure 11:
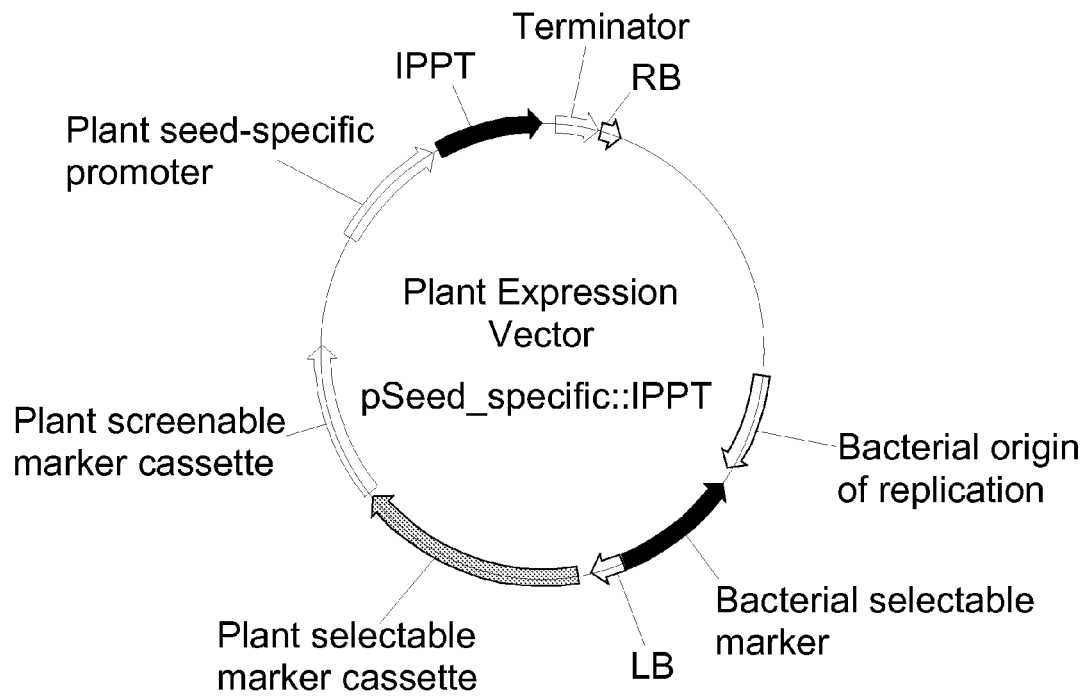
FIG. 11 shows the binary vector for increased expression in the seeds of *Oryza sativa* of a nucleic acid sequence encoding an IPPT polypeptide under the control of either a dehydrin seed-specific promoter, or of a proteinase inhibitor seed-specific promoter from rice.
Figure 13:
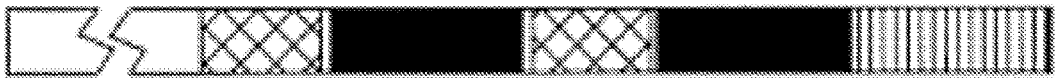
FIG. 13 shows the structure of GRAS proteins with the 5 motifs typical to this family

In one embodiment the invention relates to subject mater summarized as follows:

Item 1: Method for enhancing yield-related traits in plants relative to control plants, comprising modulating expression of a nucleic acid encoding a TCP1 or a TCP2 polypeptide in a plant, said TCP1 polypeptide comprising:

(i) a TCP domain having in increasing order of preference at least 50%, 55%, 60%, 65%, 70%, 75%, 80%, 85%, 90%, 95% or more sequence identity to the TCP domain of any one of the sequences indicated in FIG. 1; and
(ii) a domain having in increasing order of preference at least 50%, 55%, 60%, 65%, 70%, 75%, 80%, 85%, 90%, 95% or more sequence identity to Domain A of any one of the sequences indicated in FIG. 1; and
(iii) a domain having in increasing order of preference at least 50%, 55%, 60%, 65%, 70%, 75%, 80%, 85%, 90%, 95% or more sequence identity to Domain B of any one of the sequences indicated in FIG. 1; and
(iv) a domain having in increasing order of preference at least 50%, 55%, 60%, 65%, 70%, 75%, 80%, 85%, 90%, 95% or more sequence identity to Domain C of any one of the sequences indicated in FIG. 1,
and said TCP2 polypeptide comprising:
(i) a TCP domain having in increasing order of preference at least 50%, 55%, 60%, 65%, 70%, 75%, 80%, 85%, 90%, 95% or more sequence identity to the TCP domain of any of the sequences indicated in FIG. 2; and
(ii) a domain having in increasing order of preference at least 50%, 55%, 60%, 65%, 70%, 75%, 80%, 85%, 90%, 95% or more sequence identity to Domain 1 of any of the sequences indicated in FIG. 2; and
(iii) a domain having in increasing order of preference at least 50%, 55%, 60%, 65%, 70%, 75%, 80%, 85%, 90%, 95% or more sequence identity to Domain 2 of any of the sequences indicated in FIG. 2; and
(iv) a domain having in increasing order of preference at least 50%, 55%, 60%, 65%, 70%, 75%, 80%, 85%, 90%, 95% or more sequence identity to Domain 3 of any of the sequences indicated in FIG. 2.

Item 2: Method according to Item 1, wherein said TCP2 polypeptide comprises:
(v) a domain having in increasing order of preference at least 50%, 55%, 60%, 65%, 70%, 75%, 80%, 85%, 90%, 95% or more sequence identity to Domain 4 of any of the sequences indicated in FIG. 2;
(vi) a domain having in increasing order of preference at least 50%, 55%, 60%, 65%, 70%, 75%, 80%, 85%, 90%, 95% or more sequence identity to Domain 5 of any of the sequences indicated in FIG. 2.

Item 3: Method according to Item 1 or 2, wherein said TCP1 polypeptide, when used in the construction of a TCP phylogenetic tree, such as the one depicted in FIG. 1, tends to cluster with the clade of TCP polypeptides comprising the polypeptide sequence as represented by SEQ ID NO: 2 rather than with any other TCP clade.

Item 4: Method according to Item 1 or 2, wherein said TCP2 polypeptide, when used in the construction of a TCP phylogenetic tree, such as the one depicted in FIG. 2, tends to cluster with the clade of TCP polypeptides comprising the polypeptide sequence as represented by SEQ ID NO: 4 rather than with any other TCP clade.

Item 5: Method according to any one of the preceding Items, wherein said nucleic acid sequence encodes an orthologue or paralogue of SEQ ID NO: 2 or 4.

Item 6: Method according to any one of the preceding Items, wherein said modulated expression is increased expression of a nucleic acid encoding a TCP1 or a TCP2 polypeptide.

Item 7: Method according to Item 6, wherein said increased expression is effected by any one or more of T-DNA activation tagging, TILLING, or homologous recombination.

Item 8: Method according to Item 6, wherein said increased expression is effected by introducing and expressing in a plant a nucleic acid sequence encoding a TCP1 or a TCP2 polypeptide.

Item 9: Method according to any one of the preceding Items, wherein said enhanced yield-related traits comprise increased seed weight relative to control plants.

Item 10: Method according to Items 8 or 9, wherein said nucleic acid sequence is operably linked to a constitutive promoter, preferably to a HMGP (High Mobility Group Protein) promoter or to a GOS2 promoter.

Item 11: Method according to any one of Items 7 to 9, wherein said nucleic acid sequence encoding a TCP1 or TCP2 polypeptide is preferably of plant origin, further preferably from a dicotyledonous plant, more preferably from the Medicago family, most preferably from *Medicao sativa* or *Medicago truncatula*.

Item 12: Plant or part thereof including seeds obtainable by a method according to any one of Items 1 to 11, wherein said plant or part thereof comprises a nucleic acid transgene encoding a TCP1 or a TCP2 polypeptide.

Item 13: Construct comprising:
(i) nucleic acid sequence encoding a TCP1 or a TCP2 polypeptide;
(ii) one or more control sequences capable of driving expression of the nucleic acid sequence of (i); and optionally
(iii) a transcription termination sequence.

Item 14: Construct according to Item 13, wherein said one or more control sequences is at least a constitutive promoter, preferably an HMGP or GOS2 promoter.

Item 15: Use of a construct according to Items 13 or 14 for making plants having increased yield, particularly seed yield, relative to control plants.

Item 16: Plant, plant part, or plant cell transformed with a construct according to Items 13 or 14.

Item 17: Method for the production of a transgenic plant having increased seed yield relative to control plants, which method comprises:
(i) introducing and expressing in a plant or plant cell a nucleic acid sequence encoding a TCP1 or a TCP2 polypeptide; and
(ii) cultivating the plant cell under conditions promoting plant growth and development.

Item 18: Transgenic plant having increased yield, particularly increased seed yield, relative to control plants, said increased yield resulting from increased expression of a nucleic acid encoding a TCP1 or a TCP2 polypeptide, or a transgenic plant cell derived from said transgenic plant.

Item 19: Transgenic plant according to Item 18, wherein said increased seed yield is one or more of the following: (i) increased seed weight; (ii) increased harvest index; or (iii) increased Thousand Kernel Weight, (iv) increased number of flowers per panicle, (v) increased fill rate, (vi) increased number of filled seeds.

Item 20: Transgenic plant according to Item 12, 16, 18 or 19, wherein said plant is a crop plant or a monocot or a cereal, such as rice, maize, wheat, barley, millet, rye, sorghum and oats, or a transgenic plant cell derived from said transgenic plant.

Item 21: Harvestable parts of a plant according to Item 20, wherein said harvestable parts are preferably seeds.

Item 22: Products derived from a plant according to Item 20 and/or from harvestable parts of a plant according to Item 21.

Item 23: Use of a nucleic acid encoding a TCP1 or TCP2 polypeptide in increasing yield, particularly seed yield in plants.

Item 24: A method for enhancing yield-related traits in plants relative to control plants, comprising modulating expression in a plant of a nucleic acid encoding an Epsin-like polypeptide, wherein said Epsin-like polypeptide comprises an ENTH domain.

Item 25: Method according to Item 24, wherein said Epsin-like polypeptide comprises two or more of the following motifs:
(i) Motif 1: (V/I)(L/R)(D/E)AT(S/D/N)(N/D/E/S)E(P/S)WGPHG(T/S/E) (SEQ ID NO: 48),
(ii) Motif 2: F(Q/E)(Y/F)(I/L/V/R/K)(D/E)(S/P/A)(S/G/N/Q/R)G(R/K)D(Q/V/A/H/E)G(S/N/L/I/V)NVR (SEQ ID NO: 49),
(iii) Motif 3: (E/S/A/Q)(V/I/E/A)R(Q/E/D/N)KA(A/L/V/E)(A/V/S/R/K)(N/T)(R/A)(D/E/N/G)K (SEQ ID NO: 50)
(iv) Motif 4: WAD(T/S)LSRGL(V/I) (SEQ ID NO: 51)
(v) Motif 5: L(A/S)D(I/V)G(I/V)(D/V)(F/G)(D/E/P/G) (SEQ ID NO: 52)

Item 26: Method according to Item 24 or 25, wherein said modulated expression is effected by introducing and expressing in a plant a nucleic acid encoding an Epsin-like polypeptide.

Item 27: Method according to any preceding Item 24 to 26, wherein said nucleic acid encoding an Epsin-like polypeptide encodes any one of the proteins listed in Table A or is a portion of such a nucleic acid, or a nucleic acid capable of hybridising with such a nucleic acid.

Item 28: Method according to any preceding Item 24 to 27, wherein said nucleic acid sequence encodes an orthologue or paralogue of any of the proteins given in Table A.

Item 29: Method according to any preceding Item 24 to 28, wherein said enhanced yield-related traits comprise increased yield, preferably increased biomass and/or increased seed yield relative to control plants.

Item 30: Method according to any one of Items 24 to 29, wherein said enhanced yield-related traits are obtained under non-stress conditions.

Item 31: Method according to any one of Items 24 to 29, wherein said enhanced yield-related traits are obtained under conditions of mild drought.

Item 32: Method according to any one of Items 26 to 31, wherein said nucleic acid is operably linked to a constitutive promoter, preferably to a GOS2 promoter, most preferably to a GOS2 promoter from rice.

Item 33: Method according to any preceding Item 24 to 32, wherein said nucleic acid encoding an Epsin-like polypeptide is of plant origin, preferably from a dicotyledonous plant, further preferably from the family Brassicaceae, more preferably from the genus *Arabidopsis*, most preferably from *Arabidopsis thaliana*.

Item 34: Plant or part thereof, including seeds, obtainable by a method according to any preceding Item 24 to 33, wherein said plant or part thereof comprises a recombinant nucleic acid encoding an Epsin-like polypeptide.

Item 35: Construct comprising:
(i) nucleic acid encoding an Epsin-like polypeptide as defined in Items 24 or 25;
(ii) one or more control sequences capable of driving expression of the nucleic acid sequence of (a); and optionally
(iii) a transcription termination sequence.

Item 36: Construct according to Item 35, wherein one of said control sequences is a constitutive promoter, preferably a GOS2 promoter, most preferably a GOS2 promoter from rice.

Item 37: Use of a construct according to Item 35 or 36 in a method for making plants having increased yield, particularly increased seed yield relative to control plants.

Item 38: Plant, plant part or plant cell transformed with a construct according to Item 35 or 36.

Item 39: Method for the production of a transgenic plant having increased yield, particularly increased biomass and/or increased seed yield relative to control plants, comprising:
(i) introducing and expressing in a plant a nucleic acid encoding an Epsin-like polypeptide as defined in Item 24 or 25; and
(ii) cultivating the plant cell under conditions promoting plant growth and development.

Item 40: Transgenic plant having increased yield, particularly increased biomass and/or increased seed yield, relative to control plants, resulting from modulated expression of a nucleic acid encoding an Epsin-like polypeptide as defined in Item 24 or 25, or a transgenic plant cell derived from said transgenic plant.

Item 41: Transgenic plant according to Item 34, 38 or 40, or a transgenic plant cell derived thereof, wherein said plant is a crop plant or a monocot or a cereal, such as rice, maize, wheat, barley, millet, rye, triticale, sorghum and oats.

Item 42: Harvestable parts of a plant according to Item 41, wherein said harvestable parts are seeds.

Item 43: Products derived from a plant according to Item 41 and/or from harvestable parts of a plant according to Item 42.

Item 44: Use of a nucleic acid encoding an Epsin-like polypeptide in increasing yield, particularly in increasing seed yield in plants, relative to control plants.

Item 45: An isolated nucleic acid molecule comprising a nucleic acid molecule selected from the group consisting of:
a) a nucleic acid molecule encoding the polypeptide shown in SEQ ID NO:112, SEQ ID NO:138 and SEQ ID NO:142;
b) a nucleic acid molecule shown in SEQ ID NO:111, SEQ ID NO:137 and SEQ ID NO:141;
c) a nucleic acid molecule, which, as a result of the degeneracy of the genetic code, can be derived from a polypeptide sequence depicted in SEQ ID NO:112, SEQ ID NO:138 and SEQ ID NO:142 and confers enhanced yield-related traits in plants relative to control plants;
d) a nucleic acid molecule having, in increasing order of preference, at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to any one of the amino acid sequences given in SEQ ID NO:111, SEQ ID NO:137 and SEQ ID NO:141 and confers enhanced yield-related traits in plants relative to control plants;
e) a nucleic acid molecule encoding a polypeptide, in increasing order of preference, at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity with the amino acid sequence of the polypeptide encoded by the nucleic acid molecule of (a) to (c) and confers enhanced yield-related traits in plants relative to control plants;

f) nucleic acid molecule which hybridizes with a nucleic acid molecule of (a) to (c) under stringent hybridization conditions and confers enhanced yield-related traits in plants relative to control plants;

g) a nucleic acid molecule encoding a polypeptide which can be isolated with the aid of monoclonal or polyclonal antibodies made against a polypeptide encoded by one of the nucleic acid molecules of (a) to (e);

h) a nucleic acid molecule encoding a polypeptide comprising the consensus sequence or one or more polypeptide motifs as shown in Motif 1 (corresponding to SEQ ID NO: 6), Motif 2 (corresponding to SEQ ID NO: 7), Motif 3 (corresponding to SEQ ID NO: 8), Motif 4 (corresponding to SEQ ID NO: 9) or Motif 5 (corresponding to SEQ ID NO: 10);

i) nucleic acid molecule which comprises a polynucleotide, which is obtained by amplifying a cDNA library or a genomic library using the primers shown in SEQ ID NO: 46 (prm09481) and SEQ ID NO: 47 (prm09482) and j) a nucleic acid molecule which is obtainable by screening a suitable nucleic acid library under stringent hybridization conditions with a probe comprising a complementary sequence of a nucleic acid molecule of (a) or (b) or with a fragment thereof, having at least 15 nt, preferably 20 nt, 30 nt, 50 nt, 100 nt, 200 nt or 500 nt of a nucleic acid molecule complementary to a nucleic acid molecule sequence characterized in (a) to (e).

Item 46: Polypeptide encoded by a nucleic acid molecule according to item 45.

Item 47: A method for increasing yield-related traits in plants relative to control plants, comprising increasing expression in the seeds of a plant, of a nucleic acid sequence encoding a tRNA delta(2)-isopentenylpyrophosphate transferase (IPPT) polypeptide, which IPPT polypeptide comprises (i) a tRNA isopentenyltransferase domain with an InterPro accession IPR002627; and (ii) an N-terminal ATP/GTP-binding site motif A (P-loop), and optionally selecting for plants having increased yield-related traits.

Item 48: Method according to Item 47, wherein said IPPT polypeptide has (i) in increasing order of preference at least 70%, 75%, 80%, 85%, 90%, 95%, 98%, 99% or more amino acid sequence identity to an N-terminal ATP/GTP-binding site motif A (P-loop) as represented by SEQ ID NO: 199; and has in increasing order of preference at least 70%, 75%, 80%, 85%, 90%, 95%, 98%, 99% or more amino acid sequence identity to one or more of: (ii) Conserved motif I DSR(Q/L)(V/L/I) as represented by SEQ ID NO: 200; or (ii) Conserved motif II (N/D/S/T)(I/V)GTAKP(T/S) as represented by SEQ ID NO: 201; or (iii) Conserved motif III L(V/A/I)GG(S/T)GLY as represented by SEQ ID NO:202; or (iv) Conserved motif IV F/Y/L)AK(R/K/Q)Q(R/K/M)TWFR as represented by SEQ ID NO: 203.

Item 49: Method according to Item 47 or 48, wherein said IPPT polypeptide has in increasing order of preference at least 35%, 40%, 45%, 50%, 55%, 60%, 65%, 70%, 75%, 80%, 85%, 90%, 95%, 98%, 99% or more amino acid sequence identity to the IPPT polypeptide as represented by SEQ ID NO: 144 or to any of the polypeptide sequences given in Table A herein.

Item 50: Method according to any preceding Item 47 to 49, wherein said IPPT polypeptide is capable of complementing a yeast mod5 mutant strain which lacks endogenous IPPT activity, or is capable of complementing an *E. coli* miaA mutant strain which lacks endogenous IPPT activity, Item 51: Method according to any preceding Item 47 to 50, wherein said nucleic acid sequence encoding an IPPT polypeptide is represented by any one of the nucleic acid sequence SEQ ID NOs given in Table A or a portion thereof, or a sequence capable of hybridising with any one of the nucleic acid sequences SEQ ID NOs given in Table A.

Item 52: Method according to any preceding Item 47 to 51, wherein said nucleic acid sequence encodes an orthologue or paralogue of any of the polypeptide sequence SEQ ID NOs given in Table A.

Item 53: Method according to any preceding Item 47 to 52, wherein said increased expression is effected by any one or more of: T-DNA activation tagging, TILLING, or homologous recombination.

Item 54: Method according to any preceding Item 47 to 53, wherein said increased expression is effected by introducing and expressing in the seeds of a plant, a nucleic acid sequence encoding an IPPT polypeptide.

Item 55: Method according to any preceding Item 47 to 54, wherein said increased yield-related trait is one or more of: increased early vigour, increased aboveground biomass, increased total seed yield per plant, increased total number of seeds, increased number of filled seeds, increased number of flowers per panicles, and increased harvest index.

Item 56: Method according to any preceding Item 47 to 55, wherein said nucleic acid sequence is operably linked to a seed-specific promoter.

Item 57: Method according to Item 56, wherein said seed-specific promoter is a dehydrin promoter, preferably a rice dehydrin promoter, more preferably a dehydrin promoter as represented by SEQ ID NO: 204.

Item 58: Method according to Item 56, wherein said seed-specific promoter is a proteinase inhibitor promoter, preferably to a rice proteinase inhibitor promoter, more preferably a proteinase inhibitor promoter as represented by SEQ ID NO: 205.

Item 59: Method according to any preceding Item 47 to 58 wherein said nucleic acid sequence encoding an IPPT polypeptide is from the Procaryota domain, preferably from Cyanobacteria, further preferably from Chroococcales, more preferably from *Synechococcus* species, most preferably from *Synechococcus* PCC 7942.

Item 60: Plants, parts thereof (including seeds), or plant cells obtainable by a method according to any preceding Item 47 to 59, wherein said plant, part or cell thereof comprises an isolated nucleic acid transgene encoding an IPPT polypeptide, operably linked to a seed-specific promoter.

Item 61: Construct comprising:
(a) a nucleic acid sequence encoding an IPPT polypeptide as defined in any one of Items 47 to 52;
(b) one or more control sequences capable of driving expression of the nucleic acid sequence of (a); and optionally
(c) a transcription termination sequence.

Item 62: Construct according to Item 61, wherein said control sequence is a seed-specific promoter.

Item 63: Construct according to Item 62, wherein said seed-specific promoter is a dehydrin promoter, preferably a rice dehydrin promoter, more preferably a dehydrin promoter as represented by SEQ ID NO: 204.

Item 64: Construct according to Item 62, wherein said seed-specific promoter is a proteinase inhibitor promoter, preferably to a rice proteinase inhibitor promoter, more preferably a proteinase inhibitor promoter as represented by SEQ ID NO: 205.

Item 65: Use of a construct according to any one of Items 61 to 64, in a method for making plants having increased yield-related traits relative to control plants, which increased yield-related traits are one or more of: increased early vigour, increased aboveground biomass, increased total seed yield Item 66: Plant, plant part or plant cell transformed with a construct according to any one of Items 61 to 64.

Item 67: Method for the production of transgenic plants having increased yield-related traits relative to control plants, comprising:
(i) introducing and expressing in a plant, plant part, or plant cell, a nucleic acid sequence encoding an IPPT polypeptide as defined in any one of Items 47 to 52, under the control of a seed-specific promoter; and
(ii) cultivating the plant cell, plant part, or plant under conditions promoting plant growth and development.

Item 68: Transgenic plant having increased yield-related traits relative to control plants, resulting from increased expression in the seeds, of a nucleic acid sequence encoding an IPPT polypeptide as defined in any one of Items 47 to 52, operably linked to a seed-specific promoter, or a transgenic plant cell or transgenic plant part derived from said transgenic plant.

Item 69: Transgenic plant according to Item 60, 66 or 68, wherein said plant is a crop plant or a monocot or a cereal, such as rice, maize, wheat, barley, millet, rye, triticale, sorghum and oats, or a transgenic plant cell derived from said transgenic plant.

Item 70: Harvestable parts comprising an isolated nucleic acid sequence encoding an IPPT polypeptide of a plant according to Item 69, wherein said harvestable parts are preferably seeds.

Item 71: Products derived from a plant according to Item 69 and/or from harvestable parts of a plant according to Item 70.

Item 72: Use of a nucleic acid sequence encoding an IPPT polypeptide as defined in any one of Items 45 to 50 in increasing yield-related traits, comprising one or more of increased early vigour, increased aboveground biomass, increased total seed yield per plant, increased total number of seeds, increased number of filled seeds, increased number of flowers per panicles, and increased harvest index.

Item 73: A method for enhancing yield related traits in plants relative to control plants, comprising modulating expression of a nucleic acid encoding an SHR polypeptide in plants grown under conditions of sub-optimal nutrient availability.

Item 74: A method for increasing Thousand Kernel Weight (TKW) in plants relative to control plants, comprising modulating expression of a nucleic acid encoding an SHR polypeptide in plants grown under non-nutrient limiting conditions.

Item 75: Method according to Item 73 or 74, wherein said SHR polypeptide comprises any full length polypeptide which when used in the construction of a GRAS phylogenetic tree, such as the one depicted in FIG. 2, clusters with the group of SHR polypeptides comprising the amino acid sequence represented by SEQ ID NO: 209 rather than with any other group.

Item 76: Method according to Item 73 or 75, wherein said conditions of sub-optimal nutrient availability are reduced nitrogen availability relative to control plants.

Item 77: Method according to any preceding Item 73 to 76, wherein said modulated expression is effected by introducing and expressing in a plant a nucleic acid encoding an SHR polypeptide.

Item 78: Method according to any preceding Item 73 to 77, wherein said nucleic acid encoding an SHR polypeptide encodes any one of the proteins listed in Table A or is a portion of such a nucleic acid, or a nucleic acid capable of hybridising with such a nucleic acid.

Item 79: Method according to any preceding Item 73 to 78, wherein said nucleic acid sequence encodes an orthologue or paralogue of any of the proteins given in Table A.

Item 80: Method according to any one of Items 73 or 75 to 79, wherein said enhanced yield-related traits comprise increased yield, preferably increased biomass and/or increased seed yield relative to control plants.

Item 81: Method according to any one of Items 77 to 80, wherein said nucleic acid is operably linked to a constitutive promoter, preferably to a GOS2 promoter, most preferably to a GOS2 promoter from rice.

Item 82: Method according to any preceding Item 73 to 81, wherein said nucleic acid encoding an SHR polypeptide is of plant origin, preferably from a dicotyledonous plant, further preferably from the family Brassicaceae, more preferably from the genus *Arabidopsis*, most preferably from *Arabidopsis thaliana*.

Item 83: Plant or part thereof, including seeds, obtainable by a method according to any preceding Item 73 to 82, wherein said plant or part thereof comprises a recombinant nucleic acid encoding an SHR polypeptide.

Item 84: Construct comprising:
(i) nucleic acid encoding an SHR polypeptide as defined in Item 75;
(ii) one or more control sequences capable of driving expression of the nucleic acid sequence of (a); and optionally
(iii) a transcription termination sequence.

Item 85: Construct according to Item 84, wherein one of said control sequences is a constitutive promoter, preferably a GOS2 promoter, most preferably a GOS2 promoter from rice.

Item 86: Use of a construct according to Item 84 or 85 in a method for making plants having increased yield, particularly increased biomass and/or increased seed yield relative to control plants.

Item 87: Use of a construct according to Item 84 or 85 in a method for making plants having increased TKW.

Item 88: Plant, plant part or plant cell transformed with a construct according to Item 84 or 85.

Item 89: Method for the production of a transgenic plant having enhanced yield-related traits relative to control plants, comprising:
(i) introducing and expressing in a plant a nucleic acid encoding an SHR as defined in Item 75; and
(ii) cultivating the plant cell under conditions of reduced nutrient availability.

Item 90: Method for the production of a transgenic plant having increased TKW relative to control plants, comprising:
(i) introducing and expressing in a plant a nucleic acid encoding an SHR as defined in Item 75; and
(ii) cultivating the plant cell under non-nutrient limiting conditions.

Item 91: Products derived from a plant according to Item 83 or 88 and/or from harvestable parts of a plant according to Item 83 or 88.

Item 92: Use of a nucleic acid encoding an SHR polypeptide in enhancing yield-related traits, particularly in increasing seed yield and/or shoot biomass in plants, relative to control plants.

Item 93: Use of a nucleic acid encoding an SHR polypeptide in increasing TKW in plants, relative to control plants.

EXAMPLES

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence Used in the Methods of the Invention Sequences (full length cDNA, ESTs or genomic) related to the nucleic acid sequence used in the methods of the present invention were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid used in the present invention was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

List A1 provides nucleic acid sequences related to SEQ ID NO: 1, and List A2 provides nucleic acid sequences related to SEQ ID NO: 3.

The expression "List A1" as used herein are equivalent and interexchangeable with "Table A1".

The expression "List A2" as used herein are equivalent and interexchangeable with "Table A2".

The term "table A" used in this specification is to be taken to specify the content of table A1, table A2, table A3, table A4, and/or table A5.

The term "table A1" used in this specification is to be taken to specify the content of table A1.

The term "table A2" used in this specification is to be taken to specify the content of table A2.

The term "table A3" used in this specification is to be taken to specify the content of table A3.

The term "table A4" used in this specification is to be taken to specify the content of table A4.

The term "table A5" used in this specification is to be taken to specify the content of table A5.

In one preferred embodiment, the term "table A" means table A1. In another preferred embodiment, the term "table A" means table A2. In another preferred embodiment, the term "table A" means table A3. In another preferred embodiment, the term "table A" means table A4. In another preferred embodiment, the term "table A" means table A5.

The term "table B" used in this specification is to be taken to specify the content of table B1, table B2, table B3, and/or table B4.

The term "table B1" used in this specification is to be taken to specify the content of table B1.

The term "table B2" used in this specification is to be taken to specify the content of table B2.

The term "table B3" used in this specification is to be taken to specify the content of table B3.

The term "table B4" used in this specification is to be taken to specify the content of table B4.

In one preferred embodiment, the term "table B" means table B1. In another preferred embodiment, the term "table B" means table B2. In another preferred embodiment, the term "table B" means table B3. In another preferred embodiment, the term "table B" means table B4.

TABLE A1

Sequences related to SEQ ID NO: 1

| Name | Plant Source | Nucleic acid SEQ ID NO: | Protein SEQ ID NO: |
|---|---|---|---|
| Ms_TCP_sugar | Medicago sativa | 1 | 2 |
| AtTCP7 | Arabidopsis thaliana | 7 | 8 |
| OsTCP4 | Oryza sativa | 9 | 10 |
| OsTCP10 | Oryza sativa | 11 | 12 |
| Pt\TCP | Populus trichocarpa | 13 | 14 |
| Sl\TCP | Solanum lycopersicum | 15 | 16 |
| Vv\CAO70167 | Vitis vinifera | 17 | 18 |

TABLE A2

Sequences related to SEQ ID NO: 3

| Name | Plant Source | Nucleic acid SEQ ID NO: | Protein SEQ ID NO: |
|---|---|---|---|
| Mt_TCP2_sugar | Medicago truncatula | 3 | 4 |
| Am\TCP\CAE45599 | Antirrhinum majus | 19 | 20 |
| AT3G47620 | Arabidopsis thaliana | 21 | 22 |
| AtTCP15 | Arabidopsis thaliana | 23 | 24 |
| Gh\TCP\AAD48836 | Gossipum hirsutum | 25 | 26 |
| OSTCP12 | Oryza sativa | 27 | 28 |
| OsTCP5 | Oryza sativa | 29 | 30 |
| Pt\TCP\scaff_124.66\ [1298]\f\[31-1218] | Populus trichocarpa | 31 | 32 |
| Sd\TCP\AAT38718 | Solanum demissum | 33 | 34 |
| Vv\TCP\AAD48836 | Vitis vinifera | 35 | 36 |
| Vv\TCP\CAO62540 | Vitis vinifera | 37 | 38 |

Concerning Epsin-like sequences, table A3 provides a list of nucleic acid sequences related to the nucleic acid sequence used in the methods of the present invention.

TABLE A3

Examples of Epsin-like polypeptides:

| Plant Source | Nucleic acid SEQ ID NO: | Protein SEQ ID NO: |
|---|---|---|
| Arabidopsis thaliana | 43 | 44 |
| Arabidopsis thaliana | 65 | 66 |
| Vitis vinifera | 67 | 68 |

TABLE A3-continued

Examples of Epsin-like polypeptides:

| Plant Source | Nucleic acid SEQ ID NO: | Protein SEQ ID NO: |
|---|---|---|
| *Oryza sativa* | 69 | 70 |
| *Oryza sativa* | 71 | 72 |
| *Avena fatua* | 73 | 74 |
| *Medicago truncatula* | 75 | 76 |
| *Arabidopsis thaliana* | 77 | 78 |
| *Arabidopsis thaliana* | 79 | 80 |
| *Arabidopsis thaliana* | 81 | 82 |
| *Arabidopsis thaliana* | 83 | 84 |
| *Oryza sativa* | 85 | 86 |
| *Arabidopsis thaliana* | 87 | 88 |
| *Vitis vinifera* | 89 | 90 |
| *Arabidopsis thaliana* | 91 | 92 |
| *Arabidopsis thaliana* | 93 | 94 |
| *Vitis vinifera* | 95 | 96 |
| *Chlamydomonas reinhardtii* | 97 | 98 |
| *Ostreococcus lucimarinus* | 99 | 100 |
| *Oryza sativa* | 101 | 102 |
| *Oryza sativa* |  | 103 |
| *Oryza sativa* |  | 104 |
| *Oryza sativa* | 105 | 106 |
| *Oryza sativa* |  | 107 |
| *Oryza sativa* | 108 | 109 |
| *Oryza sativa* |  | 110 |
| *Brassica napus* | 111 | 112 |
| *Glycine max* | 113 | 114 |
| *Hordeum vulgare* | 115 | 116 |
| *Medicago truncatula* | 117 | 118 |
| *Medicago truncatula* | 119 | 120 |
| *Physcomitrella patens* | 121 | 122 |
| *Physcomitrella patens* | 123 | 124 |
| *Physcomitrella patens* | 125 | 126 |
| *Populus trichocarpa* | 127 | 128 |
| *Populus trichocarpa* | 129 | 130 |
| *Populus trichocarpa* | 131 | 132 |
| *Solanum lycopersicum* | 133 | 134 |
| *Triticum aestivum* | 135 | 136 |
| *Triticum aestivum* | 137 | 138 |
| *Arabidopsis thaliana* | 139 | 140 |
| *Zea mays* | 141 | 142 |

In some instances, related sequences have tentatively been assembled and publicly disclosed by research institutions, such as The Institute for Genomic Research (TIGR). The Eukaryotic Gene Orthologs (EGO) database may be used to identify such related sequences, either by keyword search or by using the BLAST algorithm with the nucleic acid or polypeptide sequence of interest.

Concerning IPPT, table A4 provides a list of nucleic acid sequences related to the nucleic acid sequence used in the methods of the present invention.

TABLE A4

Examples of IPPT polypeptide sequences, and encoding nucleic acid sequences:

| Name | Source organism | Public database accession number | Nucleic acid sequence SEQ ID NO: | Polypeptide sequence SEQ ID NO: |
|---|---|---|---|---|
| Synec_IPPT | *Synechococcus* sp. PCC 7942 | U30252.3 | 143 | 144 |
| Acama_IPPT (miaA) | *Acaryochloris marina* MBIC11017 | CP000828 | 145 | 146 |
| Anava_IPPT | *Anabaena variabilis* ATCC 29413 | CP000117 | 147 | 148 |
| Glovi_IPPT | *Gloeobacter violaceus* PCC 7421 | BA000045 | 149 | 150 |
| Micae_IPPT | *Microcystis aeruginosa* PCC 7806 | AM778958 | 151 | 152 |
| Nossp_IPPT | *Nostoc* sp. PCC 7120 DNA | BA000019 | 153 | 154 |
| Proma1375_IPPT | *Prochlorococcus marinus* subsp. marinus str. CCMP1375 | AE017126 | 155 | 156 |
| Proma9211_IPPT | *Prochlorococcus marinus* str. MIT 9211 | CP000878 | 157 | 158 |
| Proma9215_IPPT | *Prochlorococcus marinus* str. MIT 9215 | CP000825 | 159 | 160 |
| Proma9301_IPPT | *Prochlorococcus marinus* str. MIT 9301 | CP000576 | 161 | 162 |
| Proma9303_IPPT | *Prochlorococcus marinus* str. MIT 9303 | CP000554 | 163 | 164 |
| Proma9312_IPPT | *Prochlorococcus marinus* str. MIT 9312 | CP000111 | 165 | 166 |
| Proma9313_IPPT | *Prochlorococcus marinus* MIT9313 | BX572095 | 167 | 168 |
| Proma9515_IPPT | *Prochlorococcus marinus* str. MIT 9515 | CP000552 | 169 | 170 |
| Proma9601_IPPT | *Prochlorococcus marinus* str. AS9601 | CP000551 | 171 | 172 |
| PromaMED4_IPPT | *Prochlorococcus marinus* MED4 | BX548174 | 173 | 174 |
| PromaNATL1A_IPPT | *Prochlorococcus marinus* str. NATL1A | CP000553 | 175 | 176 |
| PromaNATL2A_IPPT | *Prochlorococcus marinus* str. NATL2A | CP000095 | 177 | 178 |
| SynecJA-3_IPPT | *Synechococcus* sp. JA-3-3Ab | CP000239 | 179 | 180 |
| Synec307_IPPT | *Synechococcus* sp. RCC307 | CT978603 | 181 | 182 |
| Synec6803_IPPT | *Synechocystis* sp. PCC 6803 DNA | BA000022 | 183 | 184 |
| Synec7803_IPPT | *Synechococcus* WH7803 | CT971583 | 185 | 186 |
| Synec8102_IPPT | *Synechococcus* sp. WH8102 | BX569689.1 | 187 | 188 |
| Synec9311_IPPT | *Synechococcus* sp. CC9311 | CP000435 | 189 | 190 |
| Synec9605_IPPT | *Synechococcus* sp. CC9605 | CP000110 | 191 | 192 |

TABLE A4-continued

Examples of IPPT polypeptide sequences, and encoding nucleic acid sequences:

| Name | Source organism | Public database accession number | Nucleic acid sequence SEQ ID NO: | Polypeptide sequence SEQ ID NO: |
|---|---|---|---|---|
| Synec9902_IPPT | *Synechococcus* sp. CC9902 | CP000097 | 193 | 194 |
| Theel_IPPT | *Thermosynechococcus elongatus* BP-1 | BA000039 | 195 | 196 |
| Trier_IPPT | *Trichodesmium erythraeum* IMS101 | CP000393 | 197 | 198 |

In some instances, related sequences have tentatively been assembled and publicly disclosed by research institutions, such as The Institute for Genomic Research (TIGR). The Eukaryotic Gene Orthologs (EGO) database may be used to identify such related sequences, either by keyword search or by using the BLAST algorithm with the nucleic acid sequence or polypeptide sequence of interest. On other instances, special nucleic acid sequence databases have been created for particular organisms, such as by the Joint Genome Institute.

Concerning SHR, table A5 provides a list of nucleic acid sequences related to the nucleic acid sequence used in the methods of the present invention.

TABLE A5

Examples of SHR polypeptides

| Name | Species of origin | Nucleic acid SEQ ID NO: | Polypeptide SEQ ID NO: |
|---|---|---|---|
| | *Arabidopsis thaliana* | 208 | 209 |
| At4g37650 | *Arabidopsis thaliana* | 210 | 211 |
| TA13018_3352 | *Pinus taeda* | 212 | 213 |
| 22633_part | *Physcomitrella patens* | 214 | 215 |
| 14911_part | *Physcomitrella patens* | 216 | 217 |
| Os03g31880 | *Oryza sativa* | 218 | 219 |
| Os07g39820 | *Oryza sativa* | 220 | 221 |
| US200510879.113 | *Zea mays* | 222 | 223 |
| TA7750_4236 | *Lactuca sativa* | 224 | 225 |
| AC147000 | *Medicago truncatula* | 226 | 227 |
| TC153082 | *Solanum tuberosum* | 228 | 229 |
| WO2005001020_215 | *Eucalyptus grandis* | 230 | 231 |
| AM431974 | *Vitis vinifera* | 232 | 233 |
| scaff_186.17 | *Populus trichocarpa* | 234 | 235 |
| TA2955_3988 | *Ricinus communis* | 236 | 237 |
| US2004031072.68433 | *Glycine max* | 238 | 239 |
| CT027662 | *Medicago truncatula* | 240 | 241 |

Example 2

Alignment of TCP Polypeptide Sequences

Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0,1 and the selected weight matrix is Blosum 62 (if polypeptides are aligned). Minor manual editing was done to further optimise the alignment. The TCP1 polypeptides are aligned in FIG. 1 and the TCP2 polypeptides in FIG. 2.

A phylogenetic tree of TCP polypeptides (FIGS. 1 and 2) was constructed using a neighbour-joining clustering algorithm as provided in the AlignX programme from the Vector NTI (Invitrogen).

Concerning Epsin-like sequences, default values are for the gap open penalty of 10, for the gap extension penalty of 0,1 and the selected weight matrix is Gonnet (if polypeptides are aligned). Minor manual editing may be done to further optimise the alignment. Sequence conservation among Epsin-like polypeptides is essentially in the N-terminal ENTH domain of the polypeptides and in the C-terminal part, the central part usually being more variable in sequence length and composition. The Epsin-like polypeptides are aligned in FIG. 2.

Multiple sequence alignment of all the IPPT polypeptide sequences in Table A4 was performed using the AlignX algorithm (from Vector NTI 10.3, Invitrogen Corporation). Results of the alignment are shown in FIG. 3 of the present application. The N-terminal ATP/GTP-binding site motif A (P-loop) as represented by SEQ ID NO: 199, the Conserved motif I DSR(Q/L)(V/L/I) as represented by SEQ ID NO: 200, the Conserved motif II (N/D/S/T)(I/V)GTAKP(T/S) as represented by SEQ ID NO: 201, the Conserved motif III L(V/A/I)GG(S/T)GLY as represented by SEQ ID NO: 202, and the Conserved motif IV F/Y/L)AK(R/K/Q)Q(R/K/M)TWFR, are boxed. The putative zinc finger motif C2H2 (C-X2-C-X(12,18)-H-X5-H found in eukaryotic tRNA-IPTs is marked with a bracket, and the conserved Cys and His residues therein are boxed.

Concerning SHR, alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0,1 and the selected weight matrix is Blosum 62 (if polypeptides are aligned). Minor manual editing was done to further optimise the alignment.

Figure 14:
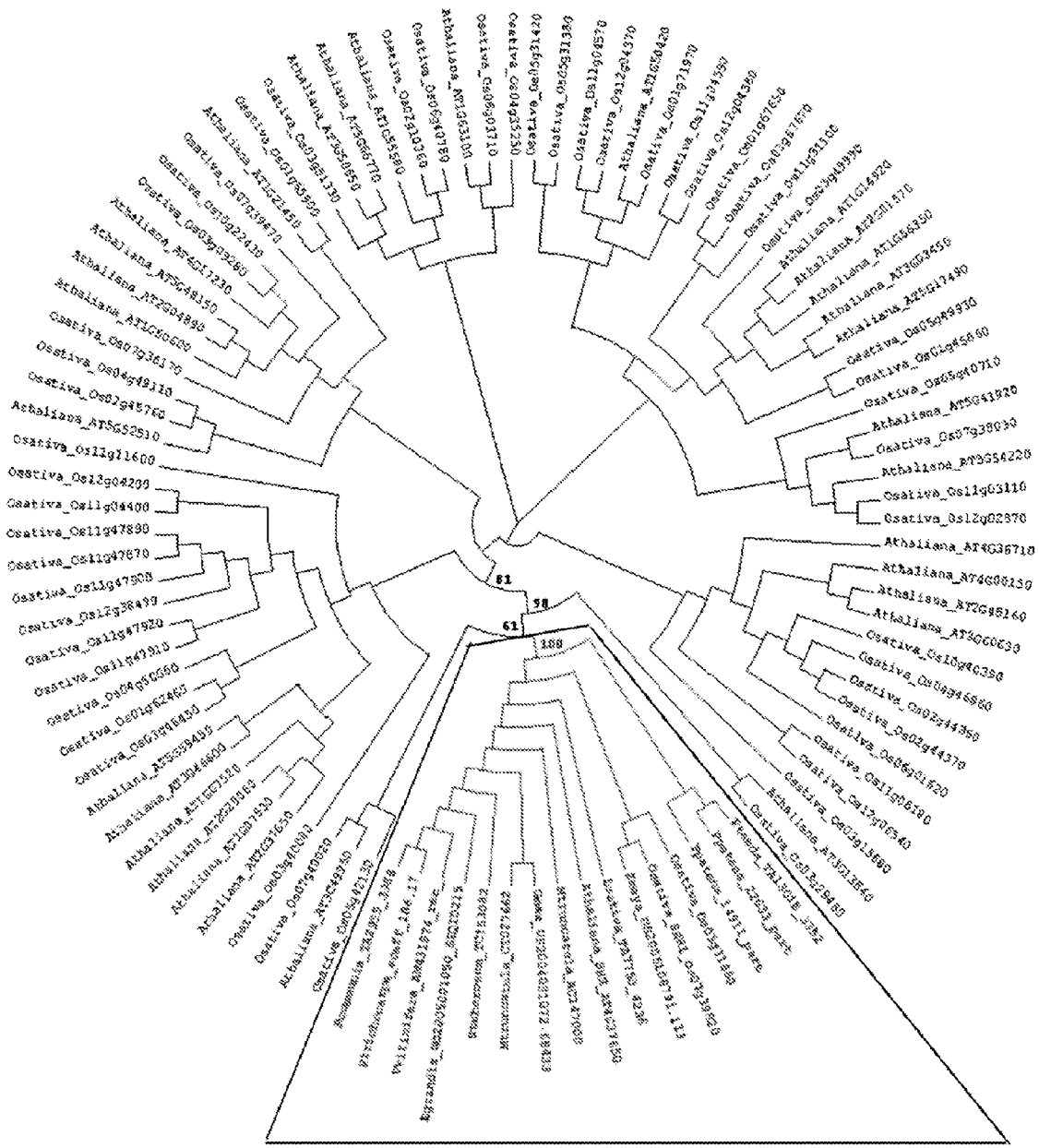
FIG. 14: Neighbour-joining tree of GRAS and SHR proteins. GRAS proteins from rice, *Arabidopsis* and SHR-related proteins from the various organisms were aligned using MUSCLE. A neighbour-joining tree was produced with CLUSTALX. Bootstrap analysis was performed for 100 iterations. The bootstrap support is shown only for the main nodes. The SHR related proteins are indicated. *A. thaliana: Arabidopsis thaliana; E. grandis: Eucalyptus grandis; G. max: Glycine max; L. sativa: Latuca sativa; M trucatula: Medicago truncatula; O. sativa: Oryza sativa; P. taeda: Pinus taeda; P. patens: Physcomitrella patens; P. trichocarpa: Populus trichocarpa; R. communis: Ricinus communis; S. tuberosum: Solanum tuberosum; V. vinifera: Vitis vinifera; Z. mays: Zea mays*; —part: partial sequence.
Figure 15:
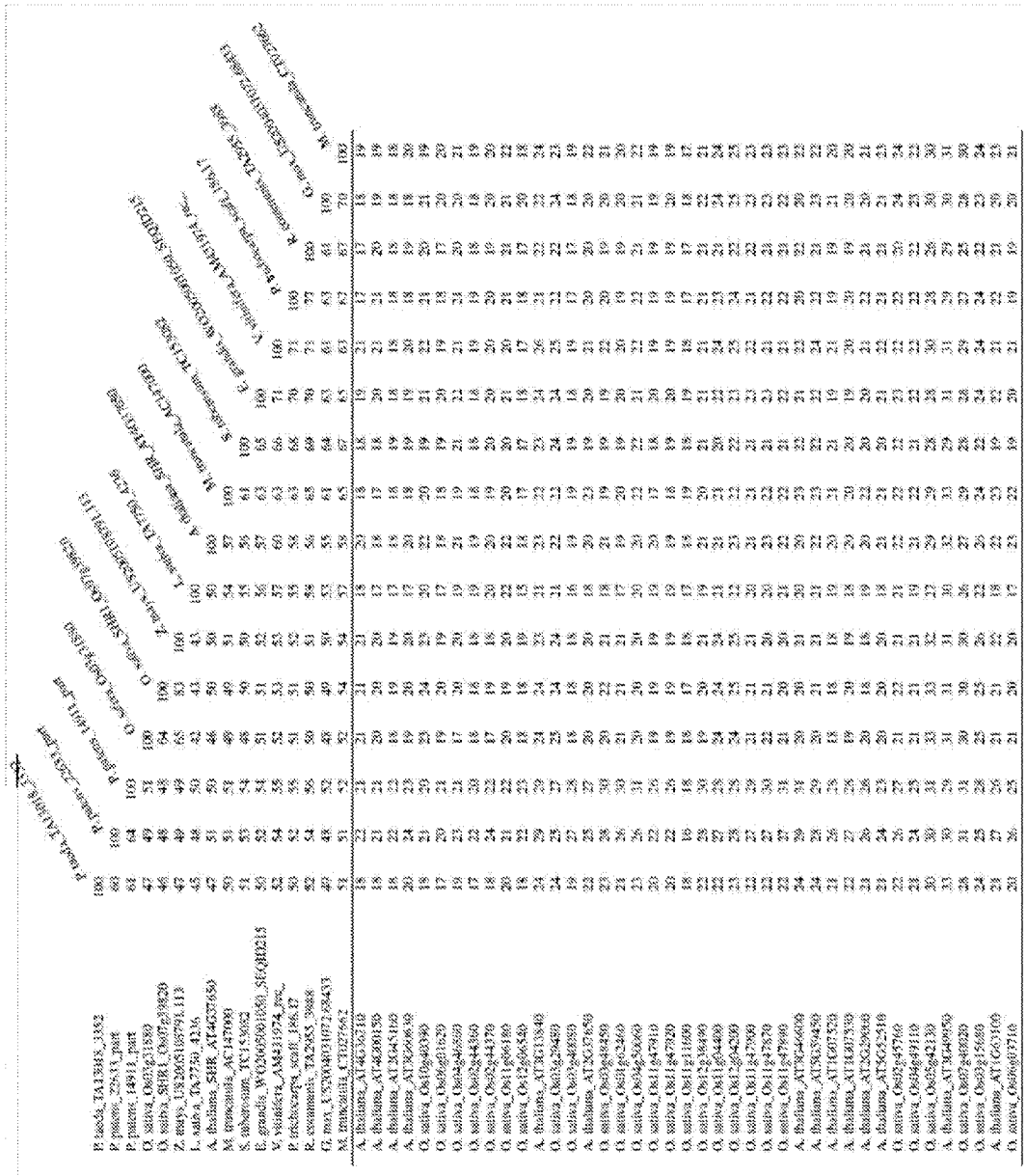
FIG. 15 shows the percentage sequence identity for members of the GRAS family with entries above the horizontal line indicating members of the SHR family. The SHR branch is highly conserved in land plants, including mosses and gymnosperms. The SHR proteins in that branch share more than 41% identity with each other, compared with less than 33% with the members of the other branches.

Regarding SHR-sequences, a phylogenetic tree of GRAS polypeptides (FIG. 14) was constructed. A neighbour-joining tree of GRAS and SHR proteins was constructed using GRAS proteins from rice, *Arabidopsis* and SHR-related proteins from the various organisms, were aligned using MUSCLE. A neighbour-joining tree was produced with CLUSTALX. Bootstrap analysis was performed for 100 iterations. The bootstrap support is shown only for the main nodes. The SHR related proteins are indicated. *A. thaliana*: *Arabidopsis thaliana*; *E. grandis*: *Eucalyptus grandis*; *G. max*: *Glycine*

*max; L. sativa: Latuca sativa; M trucatula: Medicago truncatula; O. sativa: Oryza sativa; P. taeda: Pinus taeda; P. patens: Physcomitrella patens; P. trichocarpa: Populus trichocarpa; R. communis: Ricinus communis; S. tuberosum: Solanum tuberosum; V. vinifera: Vitis vinifera; Z. mays: Zea mays;* —part: partial sequence.

Example 3

Calculation of Global Percentage Identity Between Polypeptide Sequences Useful in Performing the Methods of the Invention Concerning TCP1 or TCP2, global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

| Scoring matrix: | Blosum62 |
|---|---|
| First Gap: | 12 |
| Extending gap: | 2 |

Results of the software analysis are shown in Table B for the global similarity and identity over the full length of the polypeptide sequences. Percentage identity is given below the diagonal in bold and percentage similarity is given above the diagonal (normal face).

TABLE B

MatGAT results for global similarity and identity over the full length of the polypeptide sequences.

Ms_TCP_SUGAR family (TCP1)

| | 1 | 2 | 3 | 4 | 5 | 6 | 7 |
|---|---|---|---|---|---|---|---|
| 1. Sl\TCP | | 46.4 | 45.1 | 40.7 | 47.2 | 29.9 | 33.3 |
| 2. pt\TCP | 55.4 | | 55.6 | 49.8 | 58.3 | 37.3 | 40.3 |
| 3. Vv\CAO70167 | 63.2 | 62.8 | | 55.9 | 53.1 | 46.8 | 46.2 |
| 4. Ms_TCP_SUGAR | 55.6 | 64.3 | 65.0 | | 55.1 | 38.4 | 39.0 |
| 5. AtTCP7 | 57.6 | 66.9 | 61.6 | 70.0 | | 37.2 | 39.1 |
| 6. OsTCP10 | 47.1 | 49.4 | 60.7 | 50.4 | 50.8 | | 62.0 |
| 7. OsTCP4 | 50.2 | 50.6 | 59.2 | 53.0 | 53.2 | 73.5 | |

Mt_TCP2_SUGAR family (TCP2)

| | 1 | 2 | 3 | 4 | 5 | 6 | 7 | 8 | 9 | 10 | 11 | 12 |
|---|---|---|---|---|---|---|---|---|---|---|---|---|
| 1. Am\TCPCAE45599 | | 61.5 | 46.4 | 46.4 | 48.5 | 48.5 | 43.3 | 40.9 | 44.1 | 45.2 | 47.9 | 48.2 |
| 2. Vv\TCP\CAO62540 | 73.9 | | 46.4 | 46.4 | 62.2 | 50.7 | 40.6 | 47.4 | 47.5 | 47.0 | 53.6 | 54.3 |
| 3. Sd\TCPAAT38718 | 56.8 | 59.1 | | 100.0 | 39.9 | 34.9 | 35.9 | 35.7 | 35.9 | 34.4 | 63.2 | 64.5 |
| 4. Gh\TCP\AAD48836 | 56.8 | 59.1 | 100.0 | | 39.9 | 34.9 | 35.9 | 35.7 | 35.9 | 34.4 | 63.2 | 64.5 |
| 5. Vv\TCP\CAO48409 | 59.3 | 74.4 | 58.0 | 58.0 | | 48.9 | 38.3 | 49.8 | 47.5 | 44.7 | 43.1 | 44.5 |
| 6. Mt_TCP2_SUGAR | 63.9 | 65.4 | 46.9 | 46.9 | 60.1 | | 37.0 | 40.4 | 44.3 | 43.8 | 35.8 | 36.6 |
| 7. AtTCP14 | 54.6 | 53.4 | 45.6 | 45.6 | 46.2 | 52.4 | | 33.5 | 38.0 | 39.9 | 35.5 | 36.6 |
| 8. AtTCP15 | 57.3 | 61.6 | 56.0 | 56.0 | 64.0 | 55.5 | 45.4 | | 43.0 | 39.6 | 36.1 | 38.5 |
| 9. OsTCP12 | 59.0 | 60.5 | 49.6 | 49.6 | 58.4 | 57.5 | 48.9 | 51.9 | | 67.0 | 34.6 | 37.0 |
| 10. OsTCP5 | 60.0 | 60.2 | 46.3 | 46.3 | 54.4 | 62.5 | 50.5 | 50.0 | 75.6 | | 34.8 | 36.4 |
| 11. Pt197953_gw1.IV.3042.1 | 57.0 | 63.8 | 74.5 | 74.5 | 62.3 | 49.0 | 43.8 | 54.2 | 47.3 | 46.3 | | 88.4 |
| 12. Pt266526_gw1.124.176.1 | 58.3 | 63.8 | 75.2 | 75.2 | 61.6 | 48.8 | 44.6 | 54.5 | 47.8 | 45.9 | 93.2 | |

A MATGAT table for local alignment of a specific domain, or data on % identity/similarity between specific domains may also be constructed.

Concerning Epsin-like sequences, global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Concerning Epsin-like sequences, parameters used in the comparison were:

| Scoring matrix: | Blosum62 |
|---|---|
| First Gap: | 12 |
| Extending gap: | 2 |

Results of the software analysis are shown in Table B3 for the global similarity and identity over the full length of the polypeptide sequences. Percentage identity is given above the diagonal in bold and percentage similarity is given below the diagonal (normal face).

The percentage identity between the Epsin-like polypeptide sequences useful in performing the methods of the invention can be as low as 14% amino acid identity compared to SEQ ID NO: 44.

TABLE B3

MatGAT results for global similarity and identity over the full length of the polypeptide sequences.

| | 1 | 2 | 3 | 4 | 5 | 6 | 7 | 8 | 9 | 10 | 11 | 12 |
|---|---|---|---|---|---|---|---|---|---|---|---|---|
| 1. SEQID2 | | 96.4 | 59.5 | 46.1 | 41.0 | 40.9 | 39.5 | 37.9 | 43.0 | 25.0 | 25.4 | 25.4 |
| 2. CAB87689 | 96.5 | | 58.2 | 45.1 | 39.9 | 40.1 | 38.4 | 37.2 | 42.0 | 25.7 | 25.5 | 25.5 |
| 3. CAO43767 | 73.4 | 71.6 | | 46.7 | 42.0 | 41.5 | 40.9 | 39.4 | 43.8 | 25.4 | 27.8 | 27.8 |
| 4. CAD41810 | 61.3 | 61.3 | 61.8 | | 44.3 | 67.3 | 42.4 | 40.2 | 95.8 | 26.6 | 25.7 | 25.7 |
| 5. BAD87030 | 58.8 | 59.2 | 58.6 | 58.9 | | 40.8 | 88.0 | 82.2 | 42.8 | 24.8 | 25.0 | 25.0 |
| 6. AAB68030 | 56.1 | 56.1 | 55.3 | 76.0 | 57.5 | | 40.5 | 39.3 | 64.3 | 26.8 | 26.9 | 26.9 |
| 7. EAZ13473 | 57.5 | 56.3 | 58.3 | 58.1 | 91.2 | 56.4 | | 91.1 | 40.8 | 23.9 | 23.8 | 23.8 |
| 8. EAY75756 | 54.2 | 53.7 | 55.7 | 58.1 | 89.2 | 55.3 | 93.5 | | 38.6 | 23.2 | 24.3 | 24.0 |
| 9. EAY95411 | 58.5 | 58.5 | 59.4 | 96.3 | 56.5 | 73.2 | 55.6 | 55.7 | | 25.2 | 24.2 | 24.2 |
| 10. ABN08674 | 36.8 | 36.6 | 37.2 | 35.8 | 37.8 | 38.1 | 36.4 | 35.8 | 34.4 | | 50.0 | 50.1 |
| 11. BAF01674 | 39.1 | 38.4 | 40.7 | 38.1 | 38.9 | 38.5 | 37.3 | 38.0 | 36.6 | 62.7 | | 99.9 |
| 12. NP_850387 | 39.1 | 38.4 | 40.7 | 38.1 | 38.9 | 38.4 | 37.3 | 37.7 | 36.6 | 62.7 | 100.0 | |
| 13. BAD44158 | 42.3 | 43.7 | 45.8 | 43.5 | 47.2 | 43.8 | 46.9 | 44.4 | 41.5 | 45.9 | 72.2 | 72.2 |
| 14. AAN72258 | 39.6 | 38.9 | 40.7 | 38.3 | 38.8 | 38.4 | 37.2 | 37.5 | 36.9 | 62.5 | 99.8 | 99.8 |
| 15. BAD19387 | 36.7 | 36.3 | 37.1 | 36.7 | 37.5 | 37.6 | 36.6 | 36.5 | 35.2 | 58.3 | 58.3 | 58.3 |
| 16. EAZ25008 | 36.7 | 36.3 | 37.1 | 36.7 | 37.5 | 37.6 | 36.6 | 36.5 | 35.2 | 58.3 | 58.3 | 58.3 |
| 17. CAB91599 | 33.3 | 33.6 | 34.6 | 34.6 | 34.5 | 35.2 | 34.5 | 34.1 | 33.5 | 59.2 | 70.5 | 70.5 |
| 18. CAO45312 | 37.4 | 38.2 | 39.1 | 38.3 | 39.7 | 40.5 | 38.6 | 38.9 | 36.8 | 58.3 | 63.6 | 63.6 |
| 19. AAL24360 | 33.5 | 33.6 | 34.9 | 34.8 | 34.5 | 35.2 | 34.5 | 34.0 | 33.7 | 59.1 | 70.4 | 70.4 |
| 20. AAC64305 | 34.1 | 33.4 | 35.3 | 31.6 | 30.7 | 28.2 | 31.7 | 30.7 | 29.5 | 24.9 | 29.5 | 29.5 |
| 21. CAN66991 | 33.8 | 34.0 | 36.7 | 35.9 | 35.6 | 35.4 | 33.8 | 34.8 | 35.0 | 56.3 | 58.7 | 58.7 |
| 22. XP001701452 | 38.9 | 39.7 | 38.1 | 36.9 | 37.1 | 35.4 | 38.9 | 38.7 | 35.2 | 29.4 | 29.1 | 29.1 |
| 23. XP001419857 | 20.5 | 20.3 | 20.5 | 18.7 | 18.5 | 18.2 | 19.3 | 18.8 | 17.5 | 12.4 | 13.5 | 13.5 |

| | 13 | 14 | 15 | 16 | 17 | 18 | 19 | 20 | 21 | 22 | 23 |
|---|---|---|---|---|---|---|---|---|---|---|---|
| 1. SEQID2 | 30.7 | 25.9 | 25.2 | 25.3 | 22.7 | 27.0 | 22.7 | 23.9 | 22.6 | 23.2 | 14.3 |
| 2. CAB87689 | 30.9 | 26.0 | 24.5 | 24.6 | 22.9 | 27.0 | 22.9 | 23.6 | 22.1 | 23.8 | 14.0 |
| 3. CAO43767 | 31.1 | 27.8 | 25.5 | 25.5 | 24.1 | 27.0 | 24.2 | 25.5 | 22.8 | 24.0 | 13.9 |
| 4. CAD41810 | 28.8 | 25.6 | 24.9 | 25.1 | 23.8 | 25.8 | 23.9 | 22.7 | 22.2 | 22.1 | 13.1 |
| 5. BAD87030 | 27.5 | 25.0 | 25.1 | 25.1 | 22.5 | 25.7 | 22.6 | 21.2 | 21.5 | 23.1 | 12.9 |
| 6. AAB68030 | 29.3 | 26.9 | 25.5 | 25.5 | 24.1 | 26.3 | 24.2 | 20.7 | 23.3 | 22.7 | 12.2 |
| 7. EAZ13473 | 27.2 | 23.8 | 23.5 | 23.5 | 23.2 | 25.1 | 23.3 | 21.9 | 20.3 | 23.9 | 13.6 |
| 8. EAY75756 | 27.7 | 24.0 | 24.0 | 24.0 | 22.9 | 25.0 | 22.9 | 20.8 | 20.3 | 22.3 | 13.3 |
| 9. EAY95411 | 26.8 | 24.1 | 23.5 | 23.8 | 22.4 | 24.4 | 22.4 | 20.5 | 21.0 | 20.8 | 11.8 |
| 10. ABN08674 | 38.0 | 49.9 | 43.5 | 43.5 | 47.7 | 47.6 | 47.3 | 21.3 | 44.5 | 19.1 | 8.1 |
| 11. BAF01674 | 72.1 | 99.7 | 46.1 | 46.0 | 62.3 | 50.1 | 62.2 | 29.3 | 43.8 | 20.1 | 8.7 |
| 12. NP_850387 | 72.2 | 99.8 | 46.0 | 45.9 | 62.4 | 50.2 | 62.3 | 29.3 | 43.9 | 20.1 | 8.7 |
| 13. BAD44158 | | 72.1 | 33.6 | 33.6 | 44.6 | 38.7 | 44.6 | 41.0 | 35.9 | 24.8 | 12.2 |
| 14. AAN72258 | 72.1 | | 45.7 | 45.6 | 62.2 | 50.2 | 62.1 | 29.2 | 43.8 | 20.1 | 8.7 |
| 15. BAD19387 | 42.0 | 58.1 | | 99.9 | 40.8 | 44.7 | 40.7 | 20.1 | 40.7 | 20.7 | 8.0 |
| 16. EAZ25008 | 42.0 | 58.1 | 100.0 | | 40.7 | 44.6 | 40.6 | 20.1 | 40.6 | 20.7 | 8.0 |
| 17. CAB91599 | 50.9 | 70.3 | 53.9 | 53.9 | | 43.3 | 99.9 | 21.8 | 38.4 | 17.9 | 8.2 |
| 18. CAO45312 | 47.8 | 63.7 | 56.8 | 56.8 | 54.9 | | 43.2 | 22.6 | 77.7 | 20.6 | 8.9 |
| 19. AAL24360 | 50.9 | 70.2 | 53.8 | 53.8 | 99.9 | 54.5 | | 21.8 | 38.3 | 17.9 | 8.3 |
| 20. AAC64305 | 41.3 | 29.4 | 23.9 | 23.9 | 23.9 | 25.7 | 23.9 | | 18.9 | 16.2 | 26.5 |
| 21. CAN66991 | 49.7 | 58.7 | 52.9 | 52.9 | 50.6 | 81.8 | 50.6 | 23.7 | | 19.5 | 8.7 |
| 22. XP001701452 | 38.9 | 29.1 | 30.7 | 30.7 | 26.6 | 31.3 | 26.6 | 26.2 | 31.7 | | 14.2 |
| 23. XP001419857 | 18.9 | 13.5 | 12.4 | 12.4 | 11.6 | 13.5 | 11.6 | 43.1 | 12.9 | 20.3 | |

Concerning IPPT, global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B4 for the global similarity and identity over the full length of the polypeptide sequences (excluding the partial polypeptide sequences).

The percentage identity between the full length polypeptide sequences useful in performing the methods of the invention can be as low as 39% amino acid identity compared to SEQ ID NO: 144.

TABLE B4

MatGAT results for global similarity and identity over the full length of the polypeptide sequences of Table A4.

|  | 1 | 2 | 3 | 4 | 5 | 6 | 7 | 8 | 9 | 10 | 11 | 12 | 13 | 14 | 15 | 16 |
|---|---|---|---|---|---|---|---|---|---|---|---|---|---|---|---|---|
| 1. Synec_IPPT |  | 55 | 54 | 42 | 51 | 53 | 41 | 42 | 41 | 41 | 45 | 42 | 44 | 39 | 41 | 39 |
| 2. Acama_IPPT | 70 |  | 65 | 48 | 58 | 66 | 39 | 42 | 40 | 42 | 43 | 42 | 42 | 41 | 41 | 42 |
| 3. Anava_IPPT | 71 | 76 |  | 49 | 66 | 94 | 39 | 41 | 41 | 42 | 43 | 43 | 43 | 41 | 42 | 43 |
| 4. Globa_IPPT | 65 | 64 | 63 |  | 45 | 49 | 35 | 40 | 36 | 37 | 39 | 37 | 38 | 37 | 38 | 37 |
| 5. Micae_IPPT | 67 | 72 | 76 | 62 |  | 64 | 43 | 39 | 42 | 42 | 42 | 44 | 42 | 42 | 43 | 42 |
| 6. Nossp_IPPT | 70 | 76 | 96 | 63 | 76 |  | 39 | 42 | 40 | 41 | 43 | 42 | 43 | 40 | 41 | 42 |
| 7. Proma1375_IPPT | 64 | 64 | 62 | 60 | 63 | 61 |  | 60 | 53 | 54 | 56 | 54 | 57 | 53 | 53 | 54 |
| 8. Proma9211_IPPT | 61 | 60 | 63 | 61 | 61 | 62 | 79 |  | 52 | 53 | 58 | 53 | 57 | 51 | 50 | 52 |
| 9. Proma9215_IPPT | 61 | 60 | 61 | 59 | 65 | 60 | 75 | 73 |  | 87 | 50 | 83 | 50 | 70 | 88 | 71 |
| 10. Proma9301_IPPT | 62 | 61 | 60 | 59 | 63 | 60 | 76 | 73 | 94 |  | 50 | 85 | 49 | 70 | 88 | 71 |
| 11. Proma9303_IPPT | 62 | 60 | 63 | 58 | 61 | 63 | 74 | 75 | 70 | 70 |  | 49 | 98 | 49 | 50 | 50 |
| 12. Proma9312_IPPT | 64 | 63 | 64 | 60 | 66 | 64 | 74 | 75 | 91 | 93 | 71 |  | 49 | 71 | 84 | 72 |
| 13. Proma9313_IPPT | 62 | 59 | 62 | 57 | 61 | 61 | 74 | 74 | 69 | 70 | 99 | 71 |  | 49 | 49 | 49 |
| 14. Proma9515_IPPT | 61 | 61 | 61 | 58 | 62 | 59 | 73 | 70 | 84 | 83 | 67 | 82 | 68 |  | 70 | 84 |
| 15. Proma9601_IPPT | 62 | 59 | 63 | 59 | 63 | 62 | 75 | 71 | 94 | 95 | 70 | 91 | 70 | 82 |  | 70 |
| 16. PromaMED4_IPPT | 61 | 62 | 61 | 60 | 63 | 61 | 76 | 71 | 86 | 84 | 69 | 84 | 69 | 92 | 84 |  |
| 17. PromaNATL1A_IPPT | 61 | 62 | 63 | 60 | 61 | 62 | 75 | 72 | 68 | 70 | 70 | 72 | 70 | 72 | 69 | 70 |
| 18. PromaNATL2A_IPPT | 61 | 61 | 61 | 59 | 61 | 60 | 74 | 71 | 67 | 70 | 69 | 72 | 69 | 71 | 69 | 70 |
| 19. Synec307_IPPT | 61 | 62 | 62 | 60 | 61 | 60 | 70 | 69 | 67 | 68 | 74 | 69 | 72 | 66 | 68 | 66 |
| 20. Synec6803_IPPT | 70 | 72 | 73 | 63 | 76 | 73 | 65 | 63 | 66 | 63 | 63 | 64 | 63 | 61 | 64 | 62 |
| 21. Synec7803_IPPT | 61 | 57 | 59 | 55 | 62 | 59 | 70 | 70 | 64 | 64 | 76 | 64 | 76 | 64 | 63 | 64 |
| 22. Synec8102_IPPT | 67 | 62 | 63 | 60 | 61 | 65 | 73 | 71 | 64 | 65 | 83 | 66 | 81 | 64 | 66 | 66 |
| 23. Synec9311_IPPT | 62 | 60 | 60 | 61 | 63 | 60 | 72 | 71 | 66 | 66 | 79 | 67 | 78 | 67 | 66 | 67 |
| 24. Synec9605_IPPT | 65 | 61 | 63 | 60 | 61 | 63 | 73 | 76 | 66 | 67 | 82 | 69 | 80 | 66 | 67 | 67 |
| 25. Synec9902_IPPT | 66 | 61 | 63 | 59 | 61 | 63 | 74 | 75 | 66 | 66 | 80 | 69 | 79 | 67 | 65 | 68 |
| 26. Synecsp_IPPT | 62 | 60 | 60 | 60 | 60 | 59 | 54 | 53 | 52 | 52 | 54 | 54 | 53 | 49 | 53 | 50 |
| 27. Theel_IPPT | 66 | 72 | 70 | 60 | 67 | 70 | 63 | 58 | 59 | 61 | 62 | 61 | 61 | 58 | 59 | 58 |
| 28. Trier_IPPT | 69 | 72 | 79 | 63 | 73 | 79 | 63 | 62 | 61 | 60 | 59 | 63 | 58 | 60 | 61 | 61 |
| 29. Escco_miaA | 57 | 55 | 53 | 57 | 57 | 53 | 54 | 55 | 49 | 50 | 54 | 50 | 53 | 51 | 52 | 51 |
| 30. Arath_IPT2 | 37 | 35 | 35 | 35 | 36 | 35 | 33 | 32 | 33 | 34 | 33 | 34 | 32 | 33 | 34 | 33 |
| 31. Sacce_MOD5_IPPT | 38 | 36 | 36 | 39 | 40 | 35 | 36 | 35 | 33 | 34 | 33 | 35 | 33 | 34 | 34 | 36 |
| 32. Homsa_IPPT | 36 | 36 | 35 | 35 | 39 | 36 | 36 | 36 | 34 | 34 | 35 | 36 | 34 | 33 | 34 | 34 |

|  | 17 | 18 | 19 | 20 | 21 | 22 | 23 | 24 | 25 | 26 | 27 | 28 | 29 | 30 | 31 | 32 |
|---|---|---|---|---|---|---|---|---|---|---|---|---|---|---|---|---|
| 1. Synec_IPPT | 40 | 41 | 44 | 52 | 42 | 44 | 42 | 46 | 45 | 46 | 49 | 53 | 39 | 20 | 22 | 20 |
| 2. Acama_IPPT | 38 | 38 | 44 | 60 | 40 | 42 | 43 | 42 | 44 | 49 | 59 | 58 | 35 | 21 | 22 | 23 |
| 3. Anava_IPPT | 40 | 39 | 46 | 62 | 40 | 43 | 42 | 43 | 45 | 49 | 56 | 65 | 35 | 20 | 21 | 23 |
| 4. Globa_IPPT | 40 | 39 | 44 | 46 | 38 | 41 | 41 | 41 | 41 | 46 | 48 | 45 | 37 | 21 | 22 | 19 |
| 5. Micae_IPPT | 39 | 39 | 43 | 61 | 42 | 42 | 43 | 41 | 43 | 46 | 52 | 59 | 35 | 21 | 23 | 23 |
| 6. Nossp_IPPT | 41 | 40 | 44 | 62 | 41 | 44 | 42 | 43 | 45 | 47 | 55 | 64 | 35 | 21 | 21 | 23 |
| 7. Proma1375_IPPT | 54 | 54 | 50 | 44 | 52 | 54 | 52 | 55 | 56 | 36 | 40 | 40 | 33 | 19 | 22 | 21 |
| 8. Proma9211_IPPT | 54 | 53 | 48 | 42 | 53 | 52 | 52 | 56 | 55 | 35 | 38 | 40 | 35 | 17 | 21 | 19 |
| 9. Proma9215_IPPT | 51 | 50 | 46 | 43 | 46 | 47 | 47 | 47 | 47 | 34 | 40 | 41 | 31 | 18 | 19 | 19 |
| 10. Proma9301_IPPT | 52 | 52 | 46 | 43 | 47 | 47 | 47 | 48 | 47 | 36 | 41 | 40 | 32 | 18 | 21 | 20 |
| 11. Proma9303_IPPT | 53 | 51 | 58 | 46 | 64 | 65 | 67 | 64 | 65 | 41 | 45 | 41 | 37 | 19 | 21 | 20 |
| 12. Proma9312_IPPT | 54 | 53 | 47 | 44 | 48 | 48 | 48 | 49 | 49 | 36 | 41 | 42 | 32 | 17 | 20 | 20 |
| 13. Proma9313_IPPT | 53 | 51 | 58 | 46 | 64 | 65 | 66 | 64 | 65 | 40 | 45 | 41 | 37 | 19 | 21 | 20 |
| 14. Proma9515_IPPT | 56 | 55 | 44 | 42 | 47 | 46 | 46 | 49 | 48 | 36 | 41 | 39 | 31 | 18 | 21 | 19 |
| 15. Proma9601_IPPT | 52 | 51 | 45 | 43 | 46 | 47 | 47 | 47 | 47 | 36 | 40 | 41 | 31 | 18 | 20 | 21 |
| 16. PromaMED4_IPPT | 53 | 53 | 46 | 45 | 47 | 49 | 48 | 50 | 48 | 35 | 40 | 40 | 31 | 19 | 22 | 19 |
| 17. PromaNATL1A_IPPT |  | 94 | 50 | 42 | 47 | 51 | 49 | 52 | 51 | 35 | 40 | 39 | 35 | 19 | 22 | 20 |
| 18. PromaNATL2A_IPPT | 96 |  | 50 | 43 | 49 | 51 | 50 | 52 | 51 | 36 | 40 | 39 | 34 | 19 | 22 | 20 |
| 19. Synec307_IPPT | 68 | 67 |  | 45 | 55 | 57 | 58 | 58 | 56 | 40 | 46 | 41 | 36 | 20 | 21 | 21 |
| 20. Synec6803_IPPT | 63 | 61 | 61 |  | 43 | 47 | 43 | 46 | 45 | 46 | 51 | 61 | 35 | 21 | 22 | 20 |

TABLE B4-continued

MatGAT results for global similarity and identity over the
full length of the polypeptide sequences of Table A4.

| | | | | | | | | | | | | | | | | |
|---|---|---|---|---|---|---|---|---|---|---|---|---|---|---|---|---|
| 21. Synec7803_IPPT | 65 | 64 | 68 | 61 |    | 68 | 71 | 66 | 66 | 39 | 41 | 39 | 35 | 19 | 21 | 19 |
| 22. Synec8102_IPPT | 71 | 70 | 75 | 64 | 78 |    | 67 | 79 | 76 | 41 | 43 | 43 | 36 | 18 | 23 | 20 |
| 23. Synec9311_IPPT | 68 | 68 | 70 | 65 | 81 | 80 |    | 66 | 68 | 41 | 43 | 41 | 37 | 20 | 21 | 19 |
| 24. Synec9605_IPPT | 71 | 69 | 72 | 63 | 78 | 87 | 80 |    | 78 | 41 | 45 | 44 | 37 | 18 | 20 | 19 |
| 25. Synec9902_IPPT | 72 | 71 | 71 | 63 | 77 | 87 | 80 | 87 |    | 39 | 44 | 44 | 37 | 19 | 21 | 20 |
| 26. Synecsp_IPPT | 52 | 51 | 54 | 58 | 53 | 54 | 56 | 55 | 53 |    | 50 | 45 | 35 | 19 | 25 | 25 |
| 27. Theel_IPPT | 59 | 59 | 59 | 65 | 60 | 60 | 62 | 61 | 60 | 62 |    | 51 | 36 | 20 | 22 | 23 |
| 28. Trier_IPPT | 62 | 60 | 57 | 73 | 60 | 62 | 62 | 61 | 63 | 59 | 69 |    | 35 | 20 | 21 | 21 |
| 29. Escco_miaA | 54 | 52 | 51 | 54 | 52 | 54 | 56 | 54 | 53 | 51 | 54 | 54 |    | 22 | 21 | 22 |
| 30. Arath_IPT2 | 33 | 32 | 32 | 35 | 33 | 33 | 34 | 32 | 33 | 34 | 35 | 35 | 38 |    | 25 | 28 |
| 31. Sacce_MOD5_IPPT | 37 | 36 | 33 | 37 | 34 | 35 | 35 | 33 | 37 | 38 | 36 | 37 | 37 | 47 |    | 32 |
| 32. Homsa_IPPT | 35 | 34 | 35 | 35 | 33 | 35 | 34 | 35 | 36 | 38 | 38 | 38 | 39 | 55 | 51 |    |

Concerning SHR, global percentages of similarity and identity between full length polypeptide sequences useful in performing the methods of the invention is determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix.

Parameters used in the comparison are:

| | |
|---|---|
| Scoring matrix: | Blosum62 |
| First Gap: | 12 |
| Extending gap: | 2 |

Example 4

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Panther, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 44 are presented in Table C1.

TABLE C1

InterPro scan results (major accession numbers) of the polypeptide sequence as represented by SEQ ID NO: 44.

| Database | Accession number | Accession name | Amino acid coordinates on SEQ ID NO 44 |
|---|---|---|---|
| InterPro | IPR001026 | Epsin, N-terminal | |
| HMMPfam | PF01417 | ENTH | 25-148 |
| HMMSmart | SM00273 | ENTH | 26-152 |
| ProfileScan | PS50942 | ENTH | 20-152 |
| InterPro | IPR008943 | Phosphoinositide-binding clathrin adaptor, N-terminal | |
| superfamily | SSF48473 | PI_bind_N | 25-238 |

The results of the InterPro scan of the polypeptide sequence as represented by SEQ ID NO: 144 are presented in Table C2.

TABLE C2

InterPro scan results of the polypeptide sequence as represented by SEQ ID NO: 144

| InterPro accession number and name | Integrated database name | Integrated database accession number | Integrated database accession name |
|---|---|---|---|
| IPR002627 tRNA isopentenyltransferase | BlastProDom | PD004674 | MIAA_SYNP7_Q8GIT6; |
| IPR002627 tRNA isopentenyltransferase | HMMPfam | PF01715.6 | IPP transferase |
| IPR002627 | HMMTigr | TIGR00174 | miaA: tRNA delta(2)- |

TABLE C2-continued

InterPro scan results of the polypeptide sequence as represented by SEQ ID NO: 144

| InterPro accession number and name | Integrated database name | Integrated database accession number | Integrated database accession name |
|---|---|---|---|
| tRNA isopentenyltransferase IPR011593 Isopentenyl transferase-like | BlastProDom | PD005388 | isopentenylpyrophosphate MIAA_SYNP7_Q8GIT6 |
| IPR non-integrated | tmhmm | PTHR11088 | TRNA DELTA(2)-ISOPENTENYLPYROPHOSPHATE TRANSFERASE-RELATED |
| IPR non-integrated | superfamily | SSF52540 | P-loop containing nucleoside triphosphate hydrolases |

Example 5

Topology Prediction of the Polypeptide Sequences Useful in Performing the Methods of the Invention TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters are selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark Concerning SEQ ID NO:44, a number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 44 are presented Table D. The "plant" organism group has been selected, no cutoffs defined, and the predicted length of the transit peptide requested. The subcellular localization of the polypeptide sequence as represented by SEQ ID NO: 44 may be the cytoplasm or nucleus, no transit peptide is predicted.

TABLE D

TargetP 1.1 analysis of the polypeptide sequence as represented by SEQ ID NO: 44

| | |
|---|---|
| Length (AA) | 560 |
| Chloroplastic transit peptide | 0.105 |
| Mitochondrial transit peptide | 0.100 |
| Secretory pathway signal peptide | 0.168 |
| Other subcellular targeting | 0.872 |
| Predicted Location | / |
| Reliability class | 2 |
| Predicted transit peptide length | / |

Example 6

Assay Related to the Polypeptide Sequences Useful in Performing the Methods of the Invention The polypeptide sequence as represented by SEQ ID NO: 2 or SEQ ID NO: 4 is a transcription factor with DNA binding activity. The ability of a transcription factor to bind to a specific DNA sequence can be tested by electrophoretic mobility shift assays (EMSAs; also called gel retardation assays), which is well known in the art, and reported specifically for TCPs by Kosugi & Ohashi (2002) Plant J 30: 337-348, and by Li et al. (2005) PNAS 102(36): 12978-83. Also reported by Kosugi & Ohashi are methods to detect dimerization partners and specifity, using for example, the yeast two-hybrid system, while Li et al. describe chromatin immunoprecipitation experiments to characterize the promoters to which TCPs bind to.

Concerning Epsin-like polypeptides, lipid binding may be performed as described by Hom et al. (2007). Solutions of phosphatidylcholine, phosphatidylethanolamine, phosphatidylserine (Avanti) and Phosphatidylinositol(4,5)bisphosphate diC16 (C16-PtdIns(4,5)P2, Echelon Biosciences Inc.) dissolved in CHCl3/MeOH/H2O (65:25:4, by volume) were mixed and dried down under vacuum. The lipids were resuspended in 50 mM Tris, 100 mM KCl (pH 7.0) and incubated at 64° C. for 1 h. The liposomes were then frozen in liquid nitrogen and thawed at 37° C. for three cycles. The liposome solution was passed through an Avanti extruder to produce 1.0 μm liposomes. Liposomes were collected by centrifugation at 25,000 g for 10 min and resuspended to a final concentration of 2 mM total lipids in 100 μl 20 mM Tris, 100 mM KCl buffer (pH 6.0, 7.0 or 8.0). Liposomes were incubated with the GST-fusion ENTH and ANTH domains or GST (2-5 μg/ml final protein concentration) for 30 min at room temperature and then collected again by centrifugation. The liposome pellets were resuspended in 100 μl of buffer and analyzed by SDS-PAGE and Coomassie brilliant blue staining for the presence of lipid-binding proteins.

Concerning IPPT, polypeptides useful in performing the methods of the invention display IPPT activity. Many assays exist to measure such IPPT activity, including complementation assays of a yeast strain with defective endogenous IPPT activity (encoded by the MOD5 gene; Golovko et al. (2002) Plant Molec Biol 49: 161-169), complementation assays of an *E. coli* strain with defective endogenous IPPT activity (encoded by the miaA gene; Dihanich et al. (1987) Mol Cell Biol 7: 177-184), or quantification of cytokinins in tRNA (Gray et al. (1996) Plant Physiol 110: 431-438, Miyawaki et al. (2006) Proc Natl Acad SCi USA 103(44): 16598-16603). A person skilled in the art is well aware of such experimental procedures to measure IPPT activity, including IPPT activity of an IPPT polypeptide as represented by SEQ ID NO: 144.

Example 7

Cloning of the Nucleic Acid Sequence Used in the Methods of the Invention

Cloning of the TCP Nucleic Acid Sequences

The nucleic acid sequences used in the methods of the invention was amplified by PCR using as template a custom-made *Medicago* cDNA library (in pCMV Sport 6.0; Invitrogen, Paisley, UK). PCR was performed using Hifi Taq DNA polymerase in standard conditions, using 200 ng of template in a 50 μl PCR mix. The primers used were:

```
TCP1-sense (SEQ ID NO: 39):
5'GGGGACAAGTTTGTACAAAAAAGCAGGCTTAAACAATGTCTAACC
ACAAGGAAACA 3'

TCP1-reverse, complementary (SEQ ID NO: 40):
5'GGGGACCACTTTGTACAAGAAAGCTGGGTGAATAAAGTACAAAAC
ACCGAA 3'

TCP2-sense (SEQ ID NO: 41):
5' GGGGACAAGTTTGTACAAAAAAGCAGGCTTAAACAATGGAATTG
GAAGGTGATCAT 3'

TCP2-reverse, complementary (SEQ ID NO: 42):
5' GGGGACCACTTTGTACAAGAAAGCTGGGTTCAGATCATACACTT
CTAATTGCTT 3'
``` which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pTCP1 or pTCP2. Plasmid pDONR201 was purchased from Invitrogen, as part of the Gateway® technology.

The entry clone comprising SEQ ID NO: 1 or SEQ ID NO: 2 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter or an HMGP promoter for constitutive expression was located upstream of this Gateway cassette.

After the LR recombination step, the resulting expression vector was transformed into *Agrobacterium* strain LBA4044 according to methods well known in the art.

Cloning of Epsin-Like Sequences

The nucleic acid sequence used in the methods of the invention was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 μl PCR mix. The primers used were

```
prm09481
(SEQ ID NO: 46; sense, start codon in bold):
5'-ggggacaagtttgtacaaaaaagcaggcttaaacaatggatttc
atgaaggtcttc-3'
and prm09482 (SEQ ID NO: 47; reverse,
complementary):
5'-ggggaccactttgtacaagaaagctgggttcacagacaatttca
ctgctt-3',
``` which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pEpsin-like. Plasmid pDONR201 was purchased from Invitrogen, as part of the Gateway® technology.

The entry clone comprising SEQ ID NO: 43 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 45) for root specific expression was located upstream of this Gateway cassette.

After the LR recombination step, the resulting expression vector pGOS2::Epsin-like (FIG. 4) was transformed into *Agrobacterium* strain LBA4044 according to methods well known in the art.

Cloning of Nucleic Acid Sequence as Represented by SEQ ID NO: 143

Unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

The *Synechococcus* sp. PCC 7942 nucleic acid sequence encoding an IPPT polypeptide sequence as represented by SEQ ID NO: 144 was amplified by PCR using as template genomic DNA extracted *Synechococcus* sp. PCC 7942. The following primers, which include the AttB sites for Gateway recombination, were used for PCR amplification:

```
1) Prm 07646 (SEQ ID NO: 206, sense):
5'-ggggacaagtttgtacaaaaaagcaggcttaaacaatggaatcg
cgtttgaaacc-3'
```

-continued

2) Prm 07645 (SEQ ID NO: 207, reverse,
complementary):
5'-ggggaccactttgtacaagaaagctgggttcaaacgccctcact
ctttcg-3'

PCR was performed using Hifi Taq DNA polymerase in standard conditions. A PCR fragment of the expected length (including attB sites) was amplified and purified also using standard methods. The first step of the Gateway procedure, the BP reaction, was then performed, during which the PCR fragment recombined in vivo with the pDONR201 plasmid to produce, according to the Gateway terminology, an "entry clone". Plasmid pDONR201 was purchased from Invitrogen, as part of the Gateway® technology.

Cloning of the SHR Nucleic Acid Sequence (SEQ ID NO: 208)

The nucleic acid sequence used in the methods of the invention was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 243; sense, start codon in bold):
5'-ggggacaagtttgtacaaaaaagcaggcttaaacaa
tggatactctctttagactagtca-3'
and (SEQ ID NO: 244; reverse, complementary):
5'-ggggaccactttgtacaagaaagctgggtaaataaaaacaaccc
tttacg-3', which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone", pSHR. Plasmid pDONR201 was purchased from Invitrogen, as part of the Gateway® technology.

The entry clone comprising SEQ ID NO: 208 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 242) for constitutive expression was located upstream of this Gateway cassette.

Figure 16:
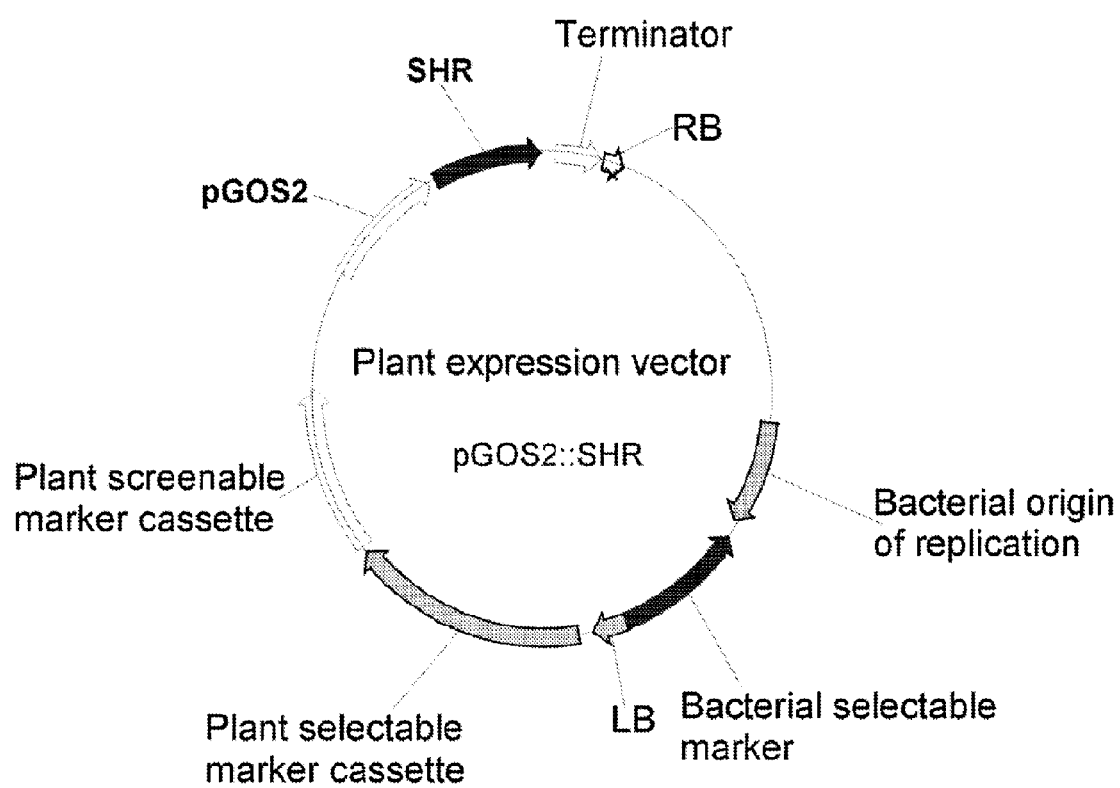
FIG. 16 represents the binary vector for increased expression in *Oryza sativa* of a SHR-encoding nucleic acid under the control of a rice GOS2 promoter (pGOS2)

After the LR recombination step, the resulting expression vector pGOS2::SHR (FIG. 16) was transformed into *Agrobacterium* strain LBA4044 according to methods well known in the art.

Example 8

Expression Vector Construction Using the Nucleic Acid Sequence as Represented by SEQ ID NO: 143

The entry clone comprising SEQ ID NO: 143 was subsequently used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice dehydrin promoter (SEQ ID NO: 204) for seed-specific expression was located upstream of this Gateway cassette. A second destination vector for *Oryza sativa* transformation was also produced, with a rice proteinase inhibitor promoter (SEQ ID NO: 205) also for seed-specific expression.

After the LR recombination step, the resulting expression vectors pDehydrin::IPPT and pProt_inhib::IPPT (FIG. 4) for seed-specific expression, were independently transformed into *Agrobacterium* strain LBA4044 according to methods well known in the art.

Example 9

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation (Concerning TCP1/TCP2 and Epsin-Like Sequences)

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 µg/ml MgCL2, and with 50 to 100 µg/ml cefotaxime and 400-500 µg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberelic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Cotton Transformation (Concerning IPPT)

Cotton (*Gossypium hirsutum* L.) transformation is performed using *Agrobacterium tumefaciens*, on hypocotyls explants. The commercial cultivars such as Coker 130 or Coker 312 (SeedCo, Lubbock, Tex.) are standard varieties used for transformation, but other varieties can also be used. The seeds are surface sterilized and germinated in the dark. Hypocotyl explants are cut from the germinated seedlings to lengths of about 1-1.5 centimeter. The hypotocyl explant is submersed in the *Agrobacterium tumefaciens* inoculum containing the expression vector, for 5 minutes then co-cultivated for about 48 hours on MS+1.8 mg/l KNO3+2% glucose at 24° C., in the dark. The explants are transferred the same medium containing appropriate bacterial and plant selectable markers (renewed several times), until embryogenic calli is seen. The calli are separated and subcultured until somatic embryos appear. Plantlets derived from the somatic embryos are matured on rooting medium until roots develop. The rooted shoots are transplanted to potting soil in the greenhouse. T1 seeds are produced from plants that exhibit tolerance to the selection agent and that contain a single copy of the T-DNA insert.

Example 10

Phenotypic Evaluation Procedure 9.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%.

In case of a confirmation round, four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Drought Screen (Concerning TCP1/TCP2 and SHR)

Concerning TCP1/TCP2, plants from T2 seeds were grown in potting soil under normal conditions until they approached the heading stage.

Concerning SHR, plants from T2 seeds are grown in potting soil under normal conditions until they approached the heading stage.

They were then transferred to a "dry" section where irrigation was withheld. Humidity probes were inserted in randomly chosen pots to monitor the soil water content (SWC). When SWC went below certain thresholds, the plants were automatically re-watered continuously until a normal level was reached again. The plants were then re-transferred again to normal conditions. The rest of the cultivation (plant maturation, seed harvest) was the same as for plants not grown under abiotic stress conditions. Growth and yield parameters are recorded as detailed for growth under normal conditions.

Drought Screen (Epsin-Like Sequences)

Plants from T2 seeds are grown in potting soil under normal conditions until they approach the heading stage. They are then transferred to a "dry" section where irrigation is withheld. Humidity probes are inserted in randomly chosen pots to monitor the soil water content (SWC). When SWC goes below certain thresholds, the plants are automatically re-watered continuously until a normal level is reached again. The plants are then re-transferred again to normal conditions. The rest of the cultivation (plant maturation, seed harvest) is the same as for plants not grown under abiotic stress conditions. Growth and yield parameters are recorded as detailed for growth under normal conditions.

Drought Screen (IPPT)

Plants from a selected number of events are grown in potting soil under normal conditions until they approached the heading stage. They are then transferred to a "dry" section where irrigation is withheld. Humidity probes are inserted in randomly chosen pots to monitor the soil water content (SWC). When SWC go below certain thresholds, the plants are automatically re-watered continuously until a normal level is reached again. The plants are then re-transferred to normal conditions. The rest of the cultivation (plant maturation, seed harvest) is the same as for plants not grown under abiotic stress conditions. Growth and yield parameters are recorded as detailed for growth under normal conditions.

Nitrogen Use Efficiency Screen (Concerning TCP1/TCP2)

Rice plants from T2 seeds are grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) was the same as for plants not grown under abiotic stress. Growth and yield parameters are recorded as detailed for growth under normal conditions.

Nitrogen Use Efficiency Screen (Concerning Epsin-Like Sequences)

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Nitrogen Use Efficiency Screen (Concerning SHR)

Rice plants from T2 seeds were grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) was the same as for plants not grown under abiotic stress. Growth and yield parameters are recorded as detailed for growth under normal conditions.

Salt Stress Screen (Concerning Epsin-Like Sequences)

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

Salt Stress Screen (Concerning IPPT)

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants were harvested. Growth and yield parameters are recorded as detailed for growth under normal conditions.

Reduced Nutrient (Nitrogen) Availability Screen (Concerning IPPT)

Plants from six events (T2 seeds) are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

9.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

Because two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment-event-segregants). P values were obtained by comparing likelihood ratio test to chi square distributions.

9.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Example 11

Results of the Phenotypic Evaluation of the Transgenic Plants

The results of the evaluation of transgenic rice plants expressing a TCP1 or TCP2 nucleic are shown below. The % difference is transgenic plants compared to corresponding nullizygotes.

Results of the Evaluation of Rice Plants Expressing Construct pHMGP::TCP1 (*Medicago sativa*) or pGOS2::TCP1 (*Medicago sativa*) Under Non-Stress and Drought Conditions

| | Drought pHMGP::TCP1 | Non-stress pHMGP::TCP1 |
|---|---|---|
| Total seed weight | 42% | 11% |
| No. filled seeds | 43% | 9% |
| Fill rate | 22% | |
| Flowers per panicle | 7% | 4% |
| No. first panicles | | 7% |
| Harvest index | 36% | 7% |
| Aboveground area | | <4% |
| Emergence vigour | | 8% |
| TKW | | <5% |

A positive tendency was noticed in the following parameters: emergence vigour, total seed weight and TKW for construct pGOS2::TCP1 (*Medicago sativa*) under non-stress conditions.

Results of the Evaluation of Rice Plants Expressing Construct or pGOS2::TCP2 (*Medicago truncatula*) Under Non-Stress and Drought Conditions

| Parameter | Drought pGOS2::TCP1 | Non-stress pGOS2::TCP1 |
|---|---|---|
| Harvest Index | 21% | 9% |
| No. Filled Seeds | 23% | 5% |
| Fill rate | Na | 6% |
| Root-Shoot index | Na | 9% |
| Total weight seeds | 27% | <5% |
| No. Flowers per panicle | 10% | Na |
| TKW | <5% | Na |
| No. first panicles | 8% | Na |

The results of the evaluation of transgenic rice plants expressing an Epsin-like nucleic acid are presented below. An increase of more than 5% was observed for total seed number, total seed yield, number of filled seeds, and fill rate. In addition, an increase of more than 5% in aboveground biomass and in early vigour was observed in both T1 and T2 generations for at least one event

TABLE E

Yield increase observed in plants expressing the Epsin-like nucleic acid of SEQ ID NO: 44:

| | T1 | | T2 | |
|---|---|---|---|---|
| | | | | P-value |
| Parameter | Overall % increase | P-value | Overall % increase | combined analysis |
| Total weight of seeds | >5 | 0.0011 | >5 | 0.0023 |
| Total number of seeds | >5 | 0.033 | >5 | 0.1068 |
| Number of filled seeds | >5 | 0.0017 | >5 | 0.0069 |
| Fill rate | >5 | 0.0024 | 2.7 | 0.0001 |

Results of the Phenotypic Evaluation of the Transgenic Rice Plants Expressing the Nucleic Acid Sequence Encoding an IPPT Polypeptide as Represented by SEQ ID NO: 144, Under the Control of a Dehydrin Seed-Specific Promoter The results of the evaluation of T1 and T2 generation transgenic rice plants expressing the nucleic acid sequence encoding an IPPT polypeptide as represented by SEQ ID NO: 144, under the control of a dehydrin seed-specific promoter, and grown under normal growth conditions, are presented below.

There was a significant increase in the early vigor, in the aboveground biomass, in the total seed yield per plant, in the total number of seeds, in the number of filled seeds, in the number of flowers per panicle, and in the harvest index of the transgenic plants compared to corresponding nullizygotes (controls), as shown in Table F

TABLE F

Results of the evaluation of T1 and T2 generation transgenic rice plants expressing the nucleic acid sequence encoding an IPPT polypeptide as represented by SEQ ID NO: 144, under the control of a dehydrin promoter for seed-specific expression.

| Trait | Overall average % increase in 6 events in the T1 generation | Overall average % increase in 4 events in the T2 generation |
|---|---|---|
| Early vigor | 25 | 25 |
| Aboveground biomass | 2 | 8 |
| Total seed yield per plant | 14 | 13 |
| Total number of seeds | 8 | 15 |
| Total number of filled seeds | 15 | 13 |
| Harvest index | 14 | 5 |
| Number of first panicles | 13 | 3 |

Results of the Phenotypic Evaluation of the Transgenic Rice Plants Expressing the Nucleic Acid Sequence Encoding an IPPT Polypeptide as Represented by SEQ ID NO: 144, Under the Control of a Proteinase Inhibitor Seed-Specific Promoter The results of the evaluation of T1 generation transgenic rice plants expressing the nucleic acid sequence encoding an IPPT polypeptide as represented by SEQ ID NO: 144, under the control of a proteinase inhibitor seed-specific promoter, and grown under normal growth conditions, are presented below.

There was a significant increase in the early vigor, in the aboveground biomass, in the total seed yield per plant, in the total number of seeds, in the number of filled seeds, and in the number of flowers per panicle, of the transgenic plants compared to corresponding nullizygotes (controls), as shown in Table G.

TABLE G

Results of the evaluation of T1 generation transgenic rice plants expressing the nucleic acid sequence encoding an IPPT polypeptide as represented by SEQ ID NO: 144, under the control of a proteinase inhibitor promoter for seed-specific expression.

| Trait | Overall average % increase in the two best events in the T1 generation |
|---|---|
| Early vigor | 34 |
| Aboveground biomass | 15 |
| Total seed yield per plant | 20 |
| Total number of seeds | 23 |

The results of the evaluation of transgenic rice plants expressing an SHR nucleic acid under non-stress conditions are presented below.

| Parameter | % difference over controls |
|---|---|
| TKW | 7.3% |

The results of the evaluation of transgenic rice plants expressing an SHR nucleic acid under conditions of reduced nitrogen availability are presented below.

| Parameter | % difference over controls |
|---|---|
| Aboveground area | 10.2% |
| Emergence vigour | 23.2% |
| Root biomass | 23.6% |

| Parameter | % difference over controls |
|---|---|
| Fill rate | 25.3% |
| TKW | 7% |

SEQUENCE LISTING (248 sequences)

SEQ ID NO: 1 - DNA, 708 bp, Medicago sativa
atgtctaaccacaaggaaacaacaactatcaccacaacaaccgatctagtagaacccacttctcaaaacgctataacagtaaaaaaaccgccgtcaaaagaccgtcacagtaaagtagacggacgaggaagacgcataagaatgcctataatttgcgccgcacgtgttttccagttaacacgtgagcttggtcataaatccgacggtcaaactattgaatggcttctccgtcaagctgaaccgtcgatcatcgccgccaccggtaccggaactactcctgcttctttctcttcgctttctgagcataaaccttttcttcaaccttctccttttattcttggtaaacgtttacgtgatgatgatggtgatgctgtttcggttgccgcacctactgctccgccggggttgtggcggccggattttgctcagctttggagctttgctgcggctgctcaaactccgccggaaggtttttctgtttctcagcataattcattgtttcatcatcaacagcaacaacaacaacaacagcaccagcaacagcaacaacagcaccaccaccagcagcatcaccagcagcaacaaggctctatgggtgaagcttccgcggcgaggttagggaattatcttcctggtcatctgaatttgttggcttcattgtctggtgggaatggaaattctggtcgtggagatgatgaagatcgttga

SEQ ID NO: 2 - protein, 235 aa, Medicago sativa
MSNHKETTTITTTTDLVEPTSQNAITVKKPPSKDRHSKVDGRGRRIRMPIICAARVFQLTRELGHKSDGQTIEWLLRQAEPSIIAATGTGTTPASFSSLSEHKPFLQPSPFILGKRLRDDDGDAVSVAAPTAPPGLWRPDFAQLWSFAAAAQTPPEGFSVSQHNSLFHHQQQQQQQQHQQQQQQHHHQQHHQQQQGSMGEASAARLGNYLPGHLNLLASLSGGNGNSGRGDDEDR

SEQ ID NO: 3 - DNA, 1251 bp, Medicago truncatula
atggaattggaaggtgatcatcatcaaagtaatggaatccgaagcagacccaatttccctcttcagcttttagagaaaaaagacaacaacatcctagatgtctccgaagaacaaacttgtacaaccaccggaaacgatggctgtactgccataatctcatcagaccagcagaaaaagcctccgccgaagcgagcttcgacgaaagaccggcacacgaaggtagacggacgaggccgccggatccgtatgccggcggcctgtgctgctagagtgttccagctcacgcgtgagctgggacataaatcagacggcgagacgattgagtggctgcttcaacaggcagagccagccgtcatcgccgccaccggaacaggaacaattccggccaactttacttcacttaatatatctcttagaagctcaggctcaaccatgtctgcgccgtctcactattttcgaggtaactactttaaccctagctcgttctcctccacggcggctcagcttagaaaccgggctgaatgggatagaactatgaacatgaacatgaacatgaacatgaacgttgtagctgatgattcaagaaggagtagtaactctaccatgttggaaaatccttcttctttatcagcaatgttgaatttcaacaacgtgcaaaatgctattctacaagcaaaacaagagcttcgggaagaaaacgccgctgccaccgcctccggtggtggcggaggatttgaattgttaggttcagattcagatggaagcatgggaagaaaaagaaggtcagagcaagaattattatcacaaaatatgggaagttatttgttacaatcaaatgtagggtcacttccttcaagtcatgcttcaaatacggcagcgttttggatggtaactggtaatgggaaccaaggtgttaatgttaatggtggtaatggaaatgatccaatttgggcaattccttctgttgggaataatggtatgtatagaggagctatgacatctcctaatggatttcatttcatgaattttgctgcatctccaatgaatcttatgccaggaagtcaattaggttcaggaatcgtcggcggtggtggtggaggtattttagccgaaagcaatctgagtatgctttcggctatgaatgcctataggcagatttcgacgaatggtatgtcaaattcgtcggggcaacatcacggcggaggtggaggaggagatgatgaacatgactcaagcagtcaacattcctaa

SEQ ID NO: 4 - protein, 416 aa, Medicago truncatula
MELEGDHHQSNGIRSRPNFPLQLLEKKDNNILDVSEEQTCTTTGNDGCTAIISSDQQKKPPPKRASTKDRHTKVDGRGRRIRMPAACAARVFQLTRELGHKSDGETIEWLLQQAEPAVIAATGTGTIPANFTSLNISLRSSGSTMSAPSHYFRGNYFNPSSFSSTAAQLRNRAEWDRTMNMNMNMNMNVVADDSRRSSNSTMLENPSSLSAMLNFNNVQNAILQAKQELREENAAATASGGGGGFELLGSDSDGSMGRKRRSEQELLSQNMGSYLLQSNVGSLPSSHASNTAAFWMVTGNGNQGVNVNGGNGNDPIWAIPSVGNNGMYRGAMTSPNGFHFMNFAASPMNLMPGSQLGSGIVGGGGGGILAESNLSMLSAMNAYRQISTNGMSNSSGQHHGGGGGGDDEHDSSSQHS

SEQ ID NO: 5 - DNA, 2193 bp, Artificial Sequence
  Promoter
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 6 - DNA, 1130 bp, Artificial Sequence
  Promoter
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcgcccttctcgcaggattcagcc

SEQ ID NO: 7 - DNA, 753 bp, Arabidopsis thaliana
atgtctattaacaacaacaacaacaacaacaacaataacaacgatggtcttatgatctcatcaaacggagctttaatcgaacaacaaccatcagtcgttgtgaagaaaccaccggcgaaagatcgacatagcaaagtcgatggaagagggagaagaatccgtatgccgattatatgtgctgctcgtgtttttcagctaacgagagagcttggtcataagtcagatggccaaacaattgaatggttacttcgtcaagcagagccttctattatagctgcaacaggaactggtacaactccagcgagtttctcaactgcttctgtctctatccgtggagccaccaattctacttctttagatcataaacccacttctttacttggtggtacgtcaccgtttatacttgggaaacgtgttagagctgatgaggatagtaataatagtcataatcatagttctgttggtaaagatgagacctttacgacaacaccagctgggttttgggctgttccggcgaggccggattttggacaagtttggagttttgctggagctccacaagagatgtttttacaacaacaacatcatcatcagcaaccattgtttgttcatcagcaacagcaacaacaagctgcaatgggtgaagcttctgctgctagagttgggaattatcttccgggtcatcttaatttgcttgcttctttatccggtggatctcccgggtcggatcgaagagaggaagatccacgttaa

SEQ ID NO: 8 - protein, 250 aa, Arabidopsis thaliana
MSINNNNNNNNNNNDGLMISSNGALIEQQPSVVVKKPPAKDRHSKVDGRGRRIRMPIICAARVFQLTRELGHKSDGQTIEWLLRQAEPSIIAATGTGTTPASFSTASVSIRGATNSTSLDHKPTSLLGGTSPFILGKRVRADEDSNNSHNHSSVGKDETFTTTPAGFWAVPARPDFGQVWSFAGAPQEMFLQQQHHHQQPLFVHQQQQQQAAMGEASAARVGNYLPGHLNLLASLSGGSPGSDRREEDPR

SEQ ID NO: 9 - DNA, 636 bp, Oryza sativa
atgagctcccgcgacgccgccgccacgttccatgtctaccagcccgtgcagatcccgacggccacggtggcgcccgctgcggcagtgtcggcggcgccggcagaggccgtcgcccagctggtcccggcgccgagcaagaaggcggccggcgcggcgggtgggaaggaccggcacagcaaggtgaacgggcgcgggcggcgcgtgcggatgccgatcgtgtgcgcggcgcgggtgttccagctcacgcgggagctggggctcaagtccgacggccagaccatcgagtggctgctccgccaggccgagccgtccatcctcgccgccacggggaccggcaccaccccggccgccttcgtctcctcctccgcgccgtccacctcctcctcgcaccagcacaccctcctcggcaagcgccagcgccaggagtccgccgccgccgacgccgtctccgtcgccggcgccgcgtccgcgttctgggcggcgctgcccgcaccaggccggcccgacgcctggggcttctccccgctggacgcgcagccgacgtacgtgccgatggcgcaggcgcaccaccaccacctcaacctcctcgccgcgctctccggcgccgccaggcgcgccgaggaggagtcccggtga

SEQ ID NO: 10 - protein, 211 aa, Oryza sativa
MSSRDAAATFHVYQPVQIPTATVAPAAAVSAAPAEAVAQLVPAPSKKAAGAAGGKDRHSKVNGRGRRVRMPIVCAARVFQLTRELGLKSDGQTIEWLLRQAEPSILAATGTGTTPAAFVSSSAPSTSSSHQHTLLGKRQRQESAAADAVSVAGAASAFWAALPAPGRPDAWGFSPLDAQPTYVPMAQAHHHHLNLLAALSGAARRAEEESR

SEQ ID NO: 11 - DNA, 621 bp, Oryza sativa
atggcctcccgcgacgccgccaccttccaggtctaccggcccatggcaatgccaacgccggcggcgctgccaccgtcgtcccagcagatcacaatgccgttcacggcggcgctcgtggacgccgtgctcccagctccccgaaaggcggcggcgacgcagggcggcaaggaccggcacagcaaggtgaacgggcgcggccggcgcgtgcgcatgccgatcgtctgcgcggcgcgcgtgttccagctcacccgcgagctggggctcaagtccgacggccagaccatcgagtggctgctccggcaggccgagccgtccatcctcgccgccaccggctccggcaccaccccggccgtcttctcctgctcgtccgccccctccaccgcctcctcctccttcctcctcggcaagcgcccgcgccaggaggaccacgaggcgccgacgttctgggaggcgctgcagcaacagccgcggcccgccgtgtcgtcgtggggtgccctcgtctcgccgtcgcaggaggcgcaggcgtacgcgtcgtcggtggcgcaggtccaccacctcaacctactctccgcgctctccggcgccgccacgagacggccagcacaggaggagtcccggtga

SEQ ID NO: 12 - protein, 206 aa, Oryza sativa
MASRDAATFQVYRPMAMPTPAALPPSSQQITMPFTAALVDAVLPAPRKAAATQGGKDRHSKVNGRGRRVRMPIVCAARVFQLTRELGLKSDGQTIEWLLRQAEPSILAATGSGTTPAVFSCSSAPSTASSSFLLGKRPRQEDHEAPTFWEALQQQPRPAVSSWGALVSPSQEAQAYASSVAQVHHLNLLSALSGAATRRPAQEESR

SEQ ID NO: 13 - DNA, 810 bp, Populus trichocarpa
atgtcagacaacagtggcgctgtaaataacggatctttgatagacccacaaagaaaccagccacctggaggtggtggtggaggaggaggagttactaatggagctttagttgctaaaaaaccaccttctaaagaccgtcatagcaaagttgatggtcgtggaaggaggattcggatgccgatcatttgtgctgctagagtttttcagttgactcgtgaattgggtcataaatccgatggacaaactattgaatggctacttcgtcaagctgagccttcgattattgctgctactggtactggaactactcctgctagtttttctactgtttctgtttcggttcgtgctggtgggaattcaaattctatatcttctctttcgagcaataatattcatccggttggttctttggagcacaagcctttgttaggcccagcgccgtttatacttgggaaaaggatgcggccggaggaggatggtaatggtggtgggaaggacgatgatggggttcctgtgggccccacaattgggtcattaatgggccccacagcaacagccgggcctggtgggttctgggctttacctgccaggcccgatttttgggggtttgctgctgctgcaccgccggaaatggttgttcagccgactgcggtgcagcagtcttcactgtttatgcaccagcatgctgcggctatgggagaagcgtcggcggcaagagtggggaattatcttcctggtcatttgaatttgctggcttctttgtcgagtggacatggaagttcaggaaggagagaggatgatcaccgttga

SEQ ID NO: 14 - protein, 269 aa, Populus trichocarpa
MSDNSGAVNNGSLIDPQRNQPPGGGGGGGGVTNGALVAKKPPSKDRHSKVDGRGRRIRMPIICAARVFQLTRELGHKSDGQTIEWLLRQAEPSIIAATGTGTTPASFSTVSVSVRAGGNSNSISSLSSNNIHPVGSLEHKPLLGPAPFILGKRMRPEEDGNGGGKDDDGVPVGPTIGSLMGPTATAGPGGFWALPARPDFWGFAAAAPPEMVVQPTAVQQSSLFMHQHAAAMGEASAARVGNYLPGHLNLLASLSSGHGSSGRREDDHR

SEQ ID NO: 15 - DNA, 594 bp, Solanum lycopersicum
atgccaattgtttgtgctgctagggtttttcagctaactcgtgaactaggtcataaatccgatggacaaacaattgaatggctgttgcgtcaagctgaaccttcgattattgctgctactggtactggtactatacctgctagtttctctactgtttcagtttcgttacgaaattcgatttcttctgttactgcttctgctccggttgatcataagttgccgtcgccgtcgccgtcgttgttacatccgttgatttctccggcgccgtttttgcttggtaagcgtttacgttctgaggatgatgataatggaagtggagataaggatgtggttcctagtgctggattttgggcagttcctgctaggccggattttggacaagtttggagtttcgctgcaccgtcgccggagatttcacattccgctgcagcagcgatgaatacgcagccatcgaggtttcttcagcagcagatggaagaggcatcagctggtagagttgggaattactttcctatagctcaagggcatctgaatttgctagcttctctatctggttcgggttctggaccgagaagggacgacgatggacaatga

SEQ ID NO: 16 - protein, 197 aa, Solanum lycopersicum
MPIVCAARVFQLTRELGHKSDGQTIEWLLRQAEPSIIAATGTGTIPASFSTVSVSLRNSISSVTASAPVDHKLPSPSPSLLHPLISPAPFLLGKRLRSEDDDNGSGDKDVVPSAGFWAVPARPDFGQVWSFAAPSPEISHSAAAAMNTQPSRFLQQQMEEASAGRVGNYFPIAQGHLNLLASLSGSGSGPRRDDDGQ

SEQ ID NO: 17 - DNA, 606 bp, Vitis vinifera
atgtctacctcagatggagcggctaacggcgttactaacggcgctattgttgactcccagaggcagcagcagcccggtaacggggccttggcggtaaagaagccgccggccaaggaccgccacagcaaagtcgacggtcggggcaggcgtatccggatgccgatcatctgcgccgccagggttttccagttgacgcgggagctggggcacaaatctgatggtcaaactatcgagtggctgctgcggcaggcggagccgtcgatcatagcggccacagggacggggaccactcctgcgagtttttcgagcccgtcgcagccgctgctcagcccgacgccgtttattctcgggaagcgtctacggggcgacgacgacgtcgacggcggggccaaagatgaggtgtggagcttcgccgctgccgcagctgctgccccgccagagatggtgccgacgatctccgggaggttcatgcagcagccgatgggagaggcgtcggcggctagagttgggaattatcttccgatcgcgcagggacatctgaatttgctggcgtcgttgtctggagctccggcatcgtcggggaggagagacgacgatccacgttga

SEQ ID NO: 18 - protein, 201 aa, Vitis vinifera
MSTSDGAANGVTNGAIVDSQRQQQPGNGALAVKKPPAKDRHSKVDGRGRRIRMPIICAARVFQLTRELGHKSDGQTIEWLLRQAEPSIIAATGTGTTPASFSSPSQPLLSPTPFILGKRLRGDDDVDGGAKDEVWSFAAAAAAAPPEMVPTISGRFMQQPMGEASAARVGNYLPIAQGHLNLLASLSGAPASSGRRDDDPR

SEQ ID NO: 19 - DNA, 1197 bp, Antirrhinum majus
  misc_feature (968)..(968): n is a, c, g, or t
atggaaggaggcgatgatcatcaccaccaccaccaccaccacaaccaaagccgcccaaacttccctttccaactactcgaaaaaaagacaaccaataatccaccctcctccgccctcgccatctccgccgacatcgcttcaaaccctagcaccaccacctccaccaccactctaactgccgcctcagccgaaacatcgaagaaaccacctccaaagcgtacatcaaccaaagaccgccacaccaaagtcgacggccgagggcgacgtatccgaatgcccgccctatgcgctgctagggtttttcagctcactcgagaactcggccacaaatctgacggcgagacaatcgagtggctgctacaacaggcagaaccctccgtcatagcagccacaggtaccggcacaattcccgctaacttcacctctctaaacatttcattacgtagctccggttcaagcatgtctgtcccatctcaactaagatcctcctacttcaatccttcgaattatacgatgatgtcgcagccgcggcgagggttttcgtttcccggtatagggttgtcatcatcagagagttcttcttcaggtaccctattgaatttccaacaggcagcggcaaatttaaaccctagcttgatgcatcaagctaagcaagaaatgcgagaaaacagtaacaataataataattcattggagtcggaggaggaaaatatggggcggaagaggagggcggagcaggagctgcagcaacaccagcatcaccagattggtaactacttggtccagtcgagtaccggaccaatggcggccagccacgcgtccataccagctaacttctggacgctggcgaattccagtaataataacaacaacaacaacaacaataataataatcaagggatggggagcgatccgatatggacgtttccatcggttaatattaacaatagcgctgctgctgctgctgntttgtacagaggaactgtttctagtgggctgcattttatgaattttccggcaccggtggcgttgttgcctagtcaacaaattggtggaaatgttttgggagaagggcagttgggtaatttcatgaacccttataggaatatcggtggaggcggaggagcgtcggagtcacaggcgagtggctcacacggtggtgatgatcggcatgatagcacaagtcaccattcttga

SEQ ID NO: 20 - protein, 398 aa, Antirrhinum majus
  misc_feature (323)..(323): Xaa can be any naturally occurring amino acid
MEGGDDHHHHHHHHNQSRPNFPFQLLEKKTTNNPPSSALAISADIASNPSTTTSTTTLTAASAETSKKPPPKRTSTKDRHTKVDGRGRRIRMPALCAARVFQLTRELGHKSDGETIEWLLQQAEPSVIAATGTGTIPANFTSLNISLRSSGSSMSVPSQLRSSYFNPSNYTMMSQPRRGFSFPGIGLSSSESSSSGTLLNFQQAAANLNPSLMHQAKQEMRENSNNNNNSLESEEENMGRKRRAEQELQQHQHHQIGNYLVQSSTGPMAASHASIPANFWTLANSSNNNNNNNNNNNNQGMGSDPIWTFPSVNINNSAAAAAXLYRGTVSSGLHFMNFPAPVALLPSQQIGGNVLGEGQLGNFMNPYRNIGGGGGASESQASGSHGGDDRHDSTSHHS

SEQ ID NO: 21 - DNA, 1470 bp, Arabidopsis thaliana
atgcaaaagccaacatcaagtatcttaaatgtcataatggacggtggagacagcgtcggaggaggaggaggagatgatcaccaccgtcacctccaccatcaccaccgccctactttcccttttcaactactcggaaaacacgaccccgacgacaaccatcaacaacaaccttccccttcctcctcctcctctctattttctctccatcaacaccaacaattatctcaatcgcaacctcaatcgcaatcgcaaaagtcacaaccgcagacaacgcaaaaagagttattacaaacgcaagaggaatctgcggtggtggcagctaaaaagccaccgttgaaacgagcgtcgacgaaagaccgacacacgaaagtagacggaagagggaggagaataaggatgccggcgttatgtgcagctagggtttttcagctaacgcgagagctaggtcataaatccgacggtgagacaatagagtggcttcttcaacaagctgaaccatctgtaatcgccgccaccggaaccggaacaatcccggcgaatttcacttctttaaacatctctctccgttcttcaggctcttccatgtctcttccttctcatttccgctccgccgcttccacttttagccctaataacatattttctccggcgatgcttcaacaacaacaacaacaacaacgtggtggtggtgttgggtttcatcatccccatctacagggacgtgcacctacgtcgtctttgtttcctggtattgataacttcacaccaacgacgtcgtttttgaactttcataatccaacaaagcaagaaggagatcaagattctgaagagttaaactcggagaagaaaagaagaatccaaacgacgtcggatttgcatcaacaacaacaacaacaccaacatgatcaaatcggaggatatacacttcaatctagcaacagtggatctacagccaccgcagccgccgcgcaacaaataccgggaaatttctggatggttgcggcggctgcggctgcaggtggtggtggtggtaataacaaccaaacaggtggtcttatgacagcttctattggtactggtggcggcggtggagagcctgtttggacgtttccttccattaacacggcagcggcagcgttatatagaagtggcgtttcgggcgttccaagcggcgcggtttctagcggtttacattttatgaatttcgcagcgccaatggcatttcttactggacaacaacagctagcaacaactagtaatcatgagattaatgaagatagtaataataatgaaggaggaagaagtgacggtggtggtgatcatcataatacacagagacatcatcatcatcaacaacaacatcatcataatattctctccggcttgaaccagtacggacggcaagtttccggcgactctcaagctagtggatcacttggaggtggtgatgaggaggatcagcaagattag

SEQ ID NO: 22 - protein, 489 aa, Arabidopsis thaliana
MQKPTSSILNVIMDGGDSVGGGGGDDHHRHLHHHHRPTFPFQLLGKHDPDDNHQQQPSPSSSSSLFSLHQHQQLSQSQPQSQSQKSQPQTTQKELLQTQEESAVVAAKKPPLKRASTKDRHTKVDGRGRRIRMPALCAARVFQLTRELGHKSDGETIEWLLQQAEPSVIAATGTGTIPANFTSLNISLRSSGSSMSLPSHFRSAASTFSPNNIFSPAMLQQQQQQQRGGGVGFHHPHLQGRAPTSSLFPGIDNFTPTTSFLNFHNPTKQEGDQDSEELNSEKKRRIQTTSDLHQQQQQHQHDQIGGYTLQSSNSGSTATAAAAQQIPGNFWMVAAAAAAGGGGGNNNQTGGLMTASIGTGGGGGEPVWTFPSINTAAAALYRSGVSGVPSGAVSSGLHFMNFAAPMAFLTGQQQLATTSNHEINEDSNNNEGGRSDGGGDHHNTQRHHHHQQQHHHNILSGLNQYGRQVSGDSQASGSLGGGDEEDQQD

SEQ ID NO: 23 - DNA, 978 bp, Arabidopsis thaliana
atggatccggatccggatcataaccatcgacccaacttccctctccagcttcttgattcttctacctcctcctcttccacttccttagccatcatctctactacttccgaacctaactccgaacctaagaagcctcctcctaaacgaacctctactaaagaccgacacaccaaagtcgaaggccgaggccgtcggatccgtatgcctgccatgtgtgctgcacgtgtctttcagctcacacgtgagcttggtcacaaatccgacggtgaaactattgagtggctactccaacaagcagaaccagcggttatagccgctacagggactggaaccattccggctaacttcacttctttaaacatctcacttcgtagctcaagatcttctctctctgctgctcatcttcgtacaactcctagtagctattactttcattcaccacatcagtccatgactcatcatcttcaacatcagcatcaggttcgtcccaagaacgagtcacattcttcgtcttcttcttcttcacagcttttagatcacaaccaaatgggtaactatctagtacaatcaactgctggatctttacctacgagtcagagtcctgcaacggcaccgttttggagtagtggtgacaacacacagaatctttgggcttttaatattaatcctcatcattccggtgttgtcgccggagatgtttacaaccccaacagtggtggtagtggcggcggtagtggagttcatttgatgaattttgcagctcctattgctttgttttctggacagcctttggcttctggttatggaggaggaggaggtggcggtggagaacatagccattatggagttttagcggcgttgaatgctgcttaccgaccggtggcggagacggggaaccataacaacaaccagcaaaaccgtgacggagatcatcatcacaaccatcaagaagatggaagcaccagtcatcattcctag

SEQ ID NO: 24 - protein, 325 aa, Arabidopsis thaliana
MDPDPDHNHRPNFPLQLLDSSTSSSSTSLAIISTTSEPNSEPKKPPPKRTSTKDRHTKVEGRGRRIRMPAMCAARVFQLTRELGHKSDGETIEWLLQQAEPAVIAATGTGTIPANFTSLNISLRSSRSSLSAAHLRTTPSSYYFHSPHQSMTHHLQHQHQVRPKNESHSSSSSSSQLLDHNQMGNYLVQSTAGSLPTSQSPATAPFWSSGDNTQNLWAFNINPHHSGVVAGDVYNPNSGGSGGGSGVHLMNFAAPIALFSGQPLASGYGGGGGGGGEHSHYGVLAALNAAYRPVAETGNHNNNQQNRDGDHHHNHQEDGSTSHHS

SEQ ID NO: 25 - DNA, 945 bp, Gossipum hirsutum
atggaaggaggaggcagtgatgatcatcaccaccaccaccacagccaccaccatcaccaccaacaaccactccaccatcatcatcatcaccaccaccgccctactttcccattccaattactagagaagaaagaagaagataaccaaccttgttcctcctcttcttcccttcctttcccttccctaccggtttcatcttcctcggccgatcaacacacctcgactcgttccatttcaacccaccagatctcgccggaaacttccaagactccaccgcctaaacgtacttcgactaaagaccgacacaccaaggtagatggacgtggtcgtaggatccgtatgccggctctttgtgcagctagggtttttcagcttactcgcgagttgggtcataaatacaatggtgaaacgatcgagtggttgctacaacaagctgagccggcggtgatcgccgctacggggactggtaccatccctgcaaacttcacttccctcaatatctcactccgtagctccggttcaagcatgtcggttccttctcagcttcgttcctcgggttttagctctaacttttctatgcaacaacgtagaagcttgttccccggaatcgggctcgaaacgacgccgacgccgacgacgttccttaacttccaatctagtagtacttcgttgggaatatcggaagaagccgaagaaagtagtttaggaaggaaacgaagacccgaacaagatttatcttcacaacatcatcagaatggggagttacttgttgcatcaagcaccgtacattccggcgagtcaccacgctcaagttccggtaacttttggatggtaactaattctaataatcaagctatgagtggtggtgaccctatatggacattccttcagttaataacagtggtttgtataggggaactatgtctagtgggttgcatttcatga

SEQ ID NO: 26 - protein, 314 aa, Gossipum hirsutum
MEGGGSDDHHHHHHSHHHHHQQPLHHHHHHHHRPTFPFQLLEKKEEDNQPCSSSSSLPFPSLPVSSSSADQHTSTRSISTHQISPETSKTPPPKRTSTKDRHTKVDGRGRRIRMPALCAARVFQLTRELGHKYNGETIEWLLQQAEPAVIAATGTGTIPANFTSLNISLRSSGSSMSVPSQLRSSGFSSNFSMQQRRSLFPGIGLETTPTPTTFLNFQSSSTSLGISEEAEESSLGRKRRPEQDLSSQHHQNGELLVASSTVHSGESPRSSSGNFWMVTNSNNQAMSGGDPIWTFLQLITVVCIGELCLVGCIS

SEQ ID NO: 27 - DNA, 1164 bp, Oryza sativa
atggatgtcaccggagacggcggaggaggagggcaacggcccaatttccccctgcagctcctcgggaagaaggaggagcagacgtgctcgacgtcgcagactgccggggcgggcggcggcggcgtcgtgggcgcgaatgggtcggcggcggcggcgccgccgaagcggacgtcgacgaaggaccggcacacgaaggtggacgggcgggggcggcgcatccggatgccggcgatctgcgccgcgcgggtgttccagctgacgcgggagctcgggcacaagaccgacggcgagaccatcgagtggctgctgcagcaggcggagccggcggtgatcgcggcgaccgggacgggcaccatcccggccaacttcacctccctcaacatctccctccgctcctccggctcgtcgctctccatcccttctcacctccgccttgccggcttggctggccctcgcttcggcggcggcgcgcgggcggcggacgcgtgggaccgcgtcgtcggcctcgggttcggcggtgcggccgacgccccgtcctccgccacctcctcctcctcgtcgccgcttctgctgagcttccactccggtagcgtcggccttgacgtgtcgccgccgtcggcgtcgacctccccggccgccgccgacctctcccggaagcggcggtgggagcaagaaatgcagcagcagcagcagtaccagcagcagatggccgggtacacgcagagccaaattcctgcgggcacggtgtggatggtgccgagcagcaacgcgcaggccgccggtggcggcgctccgccgggaggcggcggcgagtcgatttggacgttcccgcagtcagggagcggcggcggcggcggcgcggcgacagtgtaccgtggcgtgccaagcggactacatttcatgaacttcccggcgacaccaatggcgctgctccccggcgggcagcagctcggcctcgccggcgccggcgggggtggcgaggggcacccggggatcctcgccgcgctcaatgcctaccgcgcacaggccgcgcagccggacgccggcgcggcggcgcagaatggagcgcaaggctcaagtcagcatcgtcagcatcagcatcacggcggcggcggcggcggcggcgacgagcggcatgagagcatgagcgccagcgactcgtag

SEQ ID NO: 28 - protein, 387 aa, Oryza sativa
MDVTGDGGGGGQRPNFPLQLLGKKEEQTCSTSQTAGAGGGGVVGANGSAAAAPPKRTSTKDRHTKVDGRGRRIRMPAICAARVFQLTRELGHKTDGETIEWLLQQAEPAVIAATGTGTIPANFTSLNISLRSSGSSLSIPSHLRLAGLAGPRFGGGARAADAWDRVVGLGFGGAADAPSSATSSSSSPLLLSFHSGSVGLDVSPPSASTSPAAADLSRKRRWEQEMQQQQQYQQQMAGYTQSQIPAGTVWMVPSSNAQAAGGGAPPGGGGESIWTFPQSGSGGGGGAATVYRGVPSGLHFMNFPATPMALLPGGQQLGLAGAGGGGEGHPGILAALNAYRAQAAQPDAGAAAQNGAQGSSQHRQHQHHGGGGGGGDERHESMSASDS

SEQ ID NO: 29 - DNA, 1233 bp, Oryza sativa
atgaccatggacgtcgccggagacgccggaggtggccgccgcccaaacttccccttgcagcttcttgagaagaaggaggagcagccgtgctccagctcggctgcaggaggtggtactgggccatcatcggcgggtggcaacgggaacaatggatcgggaccgggcggtgccggaggggagatgcagctgcggaaggcggcgccgaagcggagctccaccaaggaccggcacaccaaggtggaagggagggggcggcgcatccggatgccggcgctgtgcgcggcgagggtgttccagctgacgcgggagctggggcacaagacggacggcgagaccatcgagtggctgctgcagcaggcggagccggcggtgatcgcggccaccggcaccggcaccatcccggccaacttcacctcgctcaatatctccctccgctcctccggatcgtcgctgtccgccccggcgcacctccgcgcgttacctagccccgccgccgccgcccggttcggatcccgtgcggacgcgtgggaccgggttgtcagcctcgggttcccgtccgagggccccgcctcgtcgtcctcgtcgccgtccccgcttctgttgaacttccactcgggcagcgtcggtctcgatgtgcaaccttcgccttccgccgctgccgccgccgccgacctctccaggaagcggcgctgggagcaggaaatgcagcagcagcaacagcaacaacagcagcagcagcagcagcagcagcaacagtaccagcagcagatggccgggtacacgcagagccaaatgccgggcaccgtgtggatggtgccgagcaacagcacgcaaggaggtgggccgtccggtggtggcggtggcggcggaggaggcagcggggagtccatttggacgttcccgcagatgagcagcgccgccgcggccgccgccgtgtaccgggggagcgttccgagcgggctacatttcatgaacttccctgcaccgatggcgctcctaccgggacagcagctggggctcggcccagttggaggcggcggtggcggtggaggaggcggggaggggcacatggggatccttgccgccctcaatgcttaccggacacaggcggcgacggatgccgccggtcagcaaggcggaggaggaggtggaggaggatctagccagcagcaacacggaggcggcggcggcggcggcgagcggcatcagagcataagcaccagcgactcgtag

SEQ ID NO: 30 - protein, 410 aa, Oryza sativa
MTMDVAGDAGGGRRPNFPLQLLEKKEEQPCSSSAAGGGTGPSSAGGNGNNGSGPGGAGGEMQLRKAAPKRSSTKDRHTKVEGRGRRIRMPALCAARVFQLTRELGHKTDGETIEWLLQQAEPAVIAATGTGTIPANFTSLNISLRSSGSSLSAPAHLRALPSPAAAARFGSRADAWDRVVSLGFPSEGPASSSSSPSPLLLNFHSGSVGLDVQPSPSAAAAAADLSRKRRWEQEMQQQQQQQQQQQQQQQQQYQQQMAGYTQSQMPGTVWMVPSNSTQGGGPSGGGGGGGGGSGESIWTFPQMSSAAAAAAVYRGSVPSGLHFMNFPAPMALLPGQQLGLGPVGGGGGGGGGGEGHMGILAALNAYRTQAATDAAGQQGGGGGGGGSSQQQHGGGGGGGERHQSISTSDS

SEQ ID NO: 31 - DNA, 1188 bp, Populus trichocarpa
atggaaggaggtgatgatcagttccaccatcagcaccatcaccagcatcaccaccgcccaaccttcccattccaattgctggaaaagaaagaagacgagccttgctcttcctcttctccttacccttctcttcccatctccactaccgaacctaacagcaacagcaacagtacgaacacaaatcactctacctcgaatctccaaattgaggttgctgaaccatcaaagaaaccccctccaaaacgaacatcaacaaaagacagacacacgaaggtggatggacgtggtcgtagaattcgcatgccagctctctgcgctgctagggtttttcagctcactcgagagcttggccacaaatcagatggtgaaaccatcgagtggttacttcaacaagctgaaccagcagtgatcgctgccacaggcacgggcacaatccctgctaatttcacttcactcaacatatccttgcgtagctctggttcaagtatgtcaattccttctcacctaagatcagggagtttcaatccaaacttttcactgcagcaacgtagtcggagtttgttccccggaattgggctagaaacctcacaaccaccgacattcctaagtttccaatctagtaacaatctgaatgcagtgctgcaagcgaagcaagaattgcgagacaattcttcactggaattatcaacggagacggaagagagtttaagcaggaaacgaaggtccgagcaagatttatcaccatcgcaacagcatcagatggggaattacttgttacaatccagtgcaggggcaatcccagctagtcatggtcaaattccagcaaatttttggatgctggctaattccaataacaatcaagtcatgagcggagaccctatatggacatttccttctgtcaacaacagtagtgtgtacagaggcagcatgtcaagtgggttgcattttatgaattttcctgctcctgttaccttattgcctagccagcaactggggtctactagcattggtggtgccagtggtggtaatagtgggataagtgaagggcatttgaacatgctagctggattgaatccctaccgaccttcaggtctatcagaatcacaggcgagtgggtctcactcacatcatggtggcggtggtggaggaagcgatgatcggcatgatacaacgagtcatcactcatag

SEQ ID NO: 32 - protein, 395 aa, Populus trichocarpa
MEGGDDQFHHQHHHQHHHRPTFPFQLLEKKEDEPCSSSSPYPSLPISTTEPNSNSNSTNTNHSTSNLQIEVAEPSKKPPPKRTSTKDRHTKVDGRGRRIRMPALCAARVFQLTRELGHKSDGETIEWLLQQAEPAVIAATGTGTIPANFTSLNISLRSSGSSMSIPSHLRSGSFNPNFSLQQRSRSLFPGIGLETSQPPTFLSFQSSNNLNAVLQAKQELRDNSSLELSTETEESLSRKRRSEQDLSPSQQHQMGNYLLQSSAGAIPASHGQIPANFWMLANSNNNQVMSGDPIWTFPSVNNSSVYRGSMSSGLHFMNFPAPVTLLPSQQLGSTSIGGASGGNSGISEGHLNMLAGLNPYRPSGLSESQASGSHSHHGGGGGGSDDRHDTTSHHS

SEQ ID NO: 33 - DNA, 960 bp, Solanum demissum
atgactacctctagtagtgatgcaccttgtgttgatcataaccaaaaatcaaaaaatcaagacaagaaacaacaagcaaaaaaaccaacaacaacaaaagatagacacacaaaggttgatggtcgtggtcgaagaattcgtatgccagcaacatgtgcagctagggtttttcaactcactagagaattaggtcacaaatctgatggtgaaactattgaatggctcttacaacaagctgaacctgctgttattgctgctactggtactggtactattccagctaattattcatcacttaatatttctttaagaagttctagacatcatagtgctagtaactacctagcacataataatattaataatttcggtcatgtttatcatgaccgaaattattttaatggggttggtttattttcgtccgaaaataattcatttttccctagtgggaatttgaacatgttacaagcgaaggaggagttatgtgatgacgatgataatgataatgataataataataatactggacgaattaagcggaggtcagaagataaagacttacaacacaataattaccatatgagtaatatgttacaatctagtacttatggttcaattccagcaagtcatcaaattgggcatattccagcaacaacgttatatatgatgacaaataataataataatactagtcatcatgaccctaataattgttctatgtgggcatctcctagtaatagtaatattgagaattcaaatattagaggagggttattgaattttatgaattttcatcaaccaattttggggacacgtggcggtggcggcggtgggacggcggcagaagggcaatgggggatgttgacggcggcgatgaactcgtatagacaaagtggtggtcatgctagtggttcttctaatcagcataatggaggagatgatcatcaacatcattcttga

SEQ ID NO: 34 - protein, 319 aa, Solanum demissum
MTTSSSDAPCVDHNQKSKNQDKKQQAKKPTTTKDRHTKVDGRGRRIRMPATCAARVFQLTRELGHKSDGETIEWLLQQAEPAVIAATGTGTIPANYSSLNISLRSSRHHSASNYLAHNNINNFGHVYHDRNYFNGVGLFSSENNSFFPSGNLNMLQAKEELCDDDDNDNDNNNNTGRIKRRSEDKDLQHNNYHMSNMLQSSTYGSIPASHQIGHIPATTLYMMTNNNNNTSHHDPNNCSMWASPSNSNIENSNIRGGLLNFMNFHQPILGTRGGGGGGTAAEGQWGMLTAAMNSYRQSGGHASGSSNQHNGGDDHQHHS

SEQ ID NO: 35 - DNA, 933 bp, Vitis vinifera
atgatcatggagggagaaaatggaatccgccgccctaattttccattacaattactagagaaaaacaaggatgaagtagcatccactgcatccaattcaggtccacagatctcggagcctcccaagaagcctccacctaaaaggacctccaccaaggataggcatactaaggtcgatgggagggggcgccgcatccgcatgcctgccacctgcgccgctagggtgtttcagttgactagggaattaggccacaagtccgacggcgagaccatcgagtggttgttacaacaggcggagcccgcagtcatcgctgccaccggaaccggtacaattcccgccaattttacttcactgaatatctctcttcggagctccggttctagcatgtctgcaccttcccacctgaggactagctactataatcccaactttgccaggaaccggaccgaatgggaaaggaatatcgatgaatctttgcgcagaattgcaaccatagggagaaagaggcagccagagcaggatccgtcccatagtcagatggggaactacttgttgcagtcgggttcggggtctatcccgtccactcatagtcagattccgaccacgttttggatggtgactaatccaagtaaccaagtgatgagtggggatcccgtgtggacatttccttctgttaataacagctccatgtatagagggaccatgtcaagtgggctacattttatgaattttcctactccaatggctctcttgcctgggcagcagttgggttcaggaattggtggaagtgggggcgtggccgatggccacttgggcatgttagccgctctcaatgcgtttaggccgcttcctggcaacggggcaccggactcgcagcagactgcttcacatccccacaacggaggagaccatagacatgatacaactagctag

SEQ ID NO: 36 - protein, 310 aa, Vitis vinifera
MIMEGENGIRRPNFPLQLLEKNKDEVASTASNSGPQISEPPKKPPPKRTSTKDRHTKVDGRGRRIRMPATCAARVFQLTRELGHKSDGETIEWLLQQAEPAVIAATGTGTIPANFTSLNISLRSSGSSMSAPSHLRTSYYNPNFARNRTEWERNIDESLRRIATIGRKRQPEQDPSHSQMGNYLLQSGSGSIPSTHSQIPTTFWMVTNPSNQVMSGDPVWTFPSVNNSSMYRGTMSSGLHFMNFPTPMALLPGQQLGSGIGGSGGVADGHLGMLAALNAFRPLPGNGAPDSQQTASHPHNGGDHRHDTTS

SEQ ID NO: 37 - DNA, 1080 bp, Vitis vinifera
atgatggaaggaggtgatgagctccacaggccaaattttccattccaattgctagaaaagaaggaagaagaagcgtgctccagctctgaacccaacaccaaccgctctaattcatctctacaaatcgcagcggagccttccaaaaagccgcctcccaagaggacttccaccaaggatcggcacaccaaagtcgacggacgtggccgccgcatccgcatgcctgcactctgcgctgctagggtttttcagctaacgcgtgagctcggccataaatccgacggcgaaaccatcgagtggctgcttcaacaggccgagcctgccgtgattgccgccaccggaaccggcacaattcctgcaaattttacgtcccttaacatctccctccggagctcgggctcaagcatgtccgtcccatctcaactaagatccacttacttcaatcccaacttctcggtccctcaaagaagaagtctttttccggggctatcatcggagaattcttccacactcgttaatttccaatctaacaatctaaattccatgtttcaagccaagcaagagttgagagacacttcactagacctatcggagactgaggagagcatagggaggaagaggcggccggagcaggatttgtcgcaacaacaaatgggaagctacttgctgcagtcgagcaccggctccatcccggccagccatggtcagattccggcgaatttttggatgctcactaattctaataaccaagtcatgagtgctgaccctatatggccatttccttctgttaataacagtaacttatataggggcactatgtccagtgggctacattttatgaattttccgactcctgttgccctcttgcctagccagcagttgagctccggcggtggaggtggcagtggtggtggcggtggtggcggcggcagtggcatgggcgagggtcactttaacatgctggctggactaaacccttatcggccggtgatggggagtggagtgtcggaatctcaggcaagtgggtctcagtcgcaccatggaggtgatgatcgacatgatgcaaccagtcaccactcatag

SEQ ID NO: 38 - protein, 359 aa, Vitis vinifera
MMEGGDELHRPNFPFQLLEKKEEEACSSSEPNTNRSNSSLQIAAEPSKKPPPKRTSTKDRHTKVDGRGRRIRMPALCAARVFQLTRELGHKSDGETIEWLLQQAEPAVIAATGTGTIPANFTSLNISLRSSGSSMSVPSQLRSTYFNPNFSVPQRRSLFPGLSSENSSTLVNFQSNNLNSMFQAKQELRDTSLDLSETEESIGRKRRPEQDLSQQQMGSYLLQSSTGSIPASHGQIPANFWMLTNSNNQVMSADPIWPFPSVNNSNLYRGTMSSGLHFMNFPTPVALLPSQQLSSGGGGGSGGGGGGGGSGMGEGHFNMLAGLNPYRPVMGSGVSESQASGSQSHHGGDDRHDATSHHS

SEQ ID NO: 39 - DNA, 56 bp, Artificial Sequence
  Primer
ggggacaagtttgtacaaaaaagcaggcttaaacaatgtctaaccacaaggaaaca

SEQ ID NO: 40 - DNA, 51 bp, Artificial Sequence
  Primer
ggggaccactttgtacaagaaagctgggtgaataaagtacaaaacaccgaa

SEQ ID NO: 41 - DNA, 56 bp, Artificial Sequence
  Primer
ggggacaagtttgtacaaaaaagcaggcttaaacaatggaattggaaggtgatcat

SEQ ID NO: 42 - DNA, 54 bp, Artificial Sequence
  Primer
ggggaccactttgtacaagaaagctgggttcagatcatacacttctaattgctt

SEQ ID NO: 43 - DNA, 2192 bp, Arabidopsis thaliana
atcggttctagctgctaactttttatttgttgttgcctttcattgaaaaaaaaaaaactcataatacaaagacgagccatctctgattagatctacacttctcctcgcaccaaaattttgccagttttcgttcctttgttcataacattttcgcggattccaaatggatttcatgaaggtcttcgatcaaactgttcgagagataaaaagggaggtgaatctgaaagttttgaaggtccctgagatggagcaaaaggtattggatgctacagataatgagccttggggtccccatggtactgcattggcagagatagctcaggccacgaagaaattctcggagtgccagatggttatgagtgttttgtggactagactaagtgagacaggaaaagattggcgatatgtctacaaggcattggctgttattgattatctgatttcgaatggatcagaacgagcggttgatgagattattgagcatacttaccaaatatcttcactcacaagttttgagtatgttgaaccaaatgggaaagatgtgggaatcaacgtgagaaagaaggcggaaaacatagtcgctcttttaaataataaagagaaaatctcagaaatcagagacaaagcagtagcaaatcgtaacaagtatgttggcctctcatcaacgggaataacatataaatctggttcctcagcttcatttggtggtagttttcaaagtggttcaagcaattttgacagctacaaggatagagattccagagaagacaagaatgactacgagtcttttcaaaagtcaagacgtggtgttaaaactgaggagcaaagctacacttctaagaagagtttttcacgctatggcagcacggaccatgacaatctatccagtggtaaaaagtcacccgattctgccaaacataggtcatatgtatctgcagctccttcaaacaacgatgatgattttgatgattttgatccacggggaacttccagtaataagccatccacaggcagtgccaaccaagtggacctttttggaggagatctgattggtgacttcttggattctgggccaacagaaacatcttccaccaacaacaacgagaactttcaagaggcggacttgtttgctgatgcagcttttgtatcagcctcggctcagggagctgaatttgggtcacagacacagaaacaagttgatcttttctctgcgtctgaaccttctgtcacagtttcttcagctcctccgacggttgatctctttgcatcttctgaatcagttgtaagcccagaagccaagatatcaatacctgagtctatggctactcccaacattgttgacccatttgctgcagttcctatggataattttgatggatcagatccttttggtgccttcacttcccactcggcttcagtttctacaggtccacaagctccaagtgtacatgggagtgcaacaaacaccacaagcccgctgtctttcgcagactcgaagccacaacatttgcaaaagaaagatcctttccaggtgaaatcaggaatttgggcagattcgctgagccgtggactgattgatctcaatataactgctcccaaaaaagcttctctagctgatgtgggtgttgtgggggatctgagcaatgaagatgggaacaaagcatctgctgcatcgtactactcaggctggtccatgggtgcaggatccgggcttggtaaaactggcctatacagtacacagcagcagcagcaacaacaacaacaacaacaagcacctgatatctcagacgatttcttctccagcctcagtaaccaaaggtaccaatctggtggctttaagcagtgaaattgtctgtgatttggtgttgagatgaaaaggcatatcaagtttgattctacattccatactggaaatgtaagtttttttaatgggtttgttgttcttgcacttcattcatgggacaatctggtcggtgactgatgtgccattgttgttgtggcgtttactttgggtttaaatgagagagagaagaattgtctttatgttttttttgataagagagtacttttattattggtttaaagtttcgatttgttcatagaacaaaagtatatgtatctcttcccactcaacaaatattttttttatcgcgtgtgattcttaatccgaaagagactccaactttcttctc

SEQ ID NO: 44 - protein, 560 aa, Arabidopsis thaliana
MDFMKVFDQTVREIKREVNLKVLKVPEMEQKVLDATDNEPWGPHGTALAEIAQATKKFSECQMVMSVLWTRLSETGKDWRYVYKALAVIDYLISNGSERAVDEIIEHTYQISSLTSFEYVEPNGKDVGINVRKKAENIVALLNNKEKISEIRDKAVANRNKYVGLSSTGITYKSGSSASFGGSFQSGSSNFDSYKDRDSREDKNDYESFQKSRRGVKTEEQSYTSKKSFSRYGSTDHDNLSSGKKSPDSAKHRSYVSAAPSNNDDDFDDFDPRGTSSNKPSTGSANQVDLFGGDLIGDFLDSGPTETSSTNNNENFQEADLFADAAFVSASAQGAEFGSQTQKQVDLFSASEPSVTVSSAPPTVDLFASSESVVSPEAKISIPESMATPNIVDPFAAVPMDNFDGSDPFGAFTSHSASVSTGPQAPSVHGSATNTTSPLSFADSKPQHLQKKDPFQVKSGIWADSLSRGLIDLNITAPKKASLADVGVVGDLSNEDGNKASAASYYSGWSMGAGSGLGKTGLYSTQQQQQQQQQQQAPDISDDFFSSLSNQRYQSGGFKQ

SEQ ID NO: 45 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 46 - DNA, 56 bp, Artificial sequence
  Primer prm09481
ggggacaagtttgtacaaaaaagcaggcttaaacaatggatttcatgaaggtcttc

SEQ ID NO: 47 - DNA, 50 bp, Artificial sequence
  Primer: prm09482
ggggaccactttgtacaagaaagctgggttcacagacaatttcactgctt

SEQ ID NO: 48 - protein, 15 aa, Artificial sequence
  Motif 1 of Epsin-like polypeptide
  VARIANT (1)..(1): Xaa can be Val or Ile
  VARIANT (2)..(2): Xaa can be Leu or Arg
  VARIANT (3)..(3): Xaa can be Asp or Glu
  VARIANT (6)..(6): Xaa can be Ser or Asp or Asn
  VARIANT (7)..(7): Xaa can be Asn or Asp or Glu or Ser
  VARIANT (9)..(9): Xaa can be Pro or Ser
  VARIANT (15)..(15): Xaa can be Thr or Ser or Glu
XXXATXXEXWGPHGX

SEQ ID NO: 49 - protein, 16 aa, Artificial sequence
  Motif 2 of Epsin-like polypeptide
  VARIANT (2)..(2): Xaa can be Gln or Glu
  VARIANT (3)..(3): Xaa can be Tyr or Phe
  VARIANT (4)..(4): Xaa can be Ile or Leu or Val or Arg or Lys
  VARIANT (5)..(5): Xaa can be Asp or Glu
  VARIANT (6)..(6): Xaa can be Ser or Pro or Ala
  VARIANT (7)..(7): Xaa can be Ser or Gly or Asn or Gln or Arg
  VARIANT (9)..(9): Xaa can be Arg or Lys
  VARIANT (11)..(11): Xaa can be Gln or Val or Ala or His or Glu
  VARIANT (13)..(13): Xaa can be Ser or Asn or Leu or Ile or Val
FXXXXXXGXDXGXNVR

SEQ ID NO: 50 - protein, 12 aa, Artificial sequence
  Motif 3 of Epsin-like polypeptide
  VARIANT (1)..(1): Xaa can Glu or Ser or Ala or Gln
  VARIANT (2)..(2): Xaa can be Val or Ile or Glu or Ala
  VARIANT (4)..(4): Xaa can be Gln or Glu or Asp or Asn
  VARIANT (7)..(7): Xaa can be Ala or Leu or Val or Glu
  VARIANT (8)..(8): Xaa can be Ala or Val or Ser or Arg or Lys
  VARIANT (9)..(9): Xaa can be Asn or Thr
  VARIANT (10)..(10): Xaa can be Arg or Ala
  VARIANT (11)..(11): Xaa can be Asp or Glu or Asn or Gly
XXRXKAXXXXXK

SEQ ID NO: 51 - protein, 10 aa, Artificial sequence
  Motif 4 of Epsin-like polypeptide
  VARIANT (4)..(4): Xaa can be Thr or Ser
  VARIANT (10)..(10): Xaa can be Val or Ile
WADXLSRGLX

SEQ ID NO: 52 - protein, 9 aa, Artificial sequence
  Motif 5 of Epsin-like polypeptide
  VARIANT (2)..(2): Xaa can be Ala or Ser
  VARIANT (4)..(4): Xaa can be Ile or Val
  VARIANT (6)..(6): Xaa can be Ile or Val
  VARIANT (7)..(7): Xaa can be Asp or Val
  VARIANT (8)..(8): Phe or Gly
  VARIANT (9)..(9): Xaa can be Asp or Glu or Pro or Gly
LXDXGXXXX

SEQ ID NO: 53 - protein, 4 aa, Artificial sequence
  Motif 6a of Epsin-like polypeptide
GGYG

SEQ ID NO: 54 - protein, 4 aa, Artificial sequence
  Motif 6b of Epsin-like polypeptide
GSYG

SEQ ID NO: 55 - protein, 4 aa, Artificial sequence
  Motif 6c of Epsin-like polypeptide
GGYD

SEQ ID NO: 56 - protein, 4 aa, Artificial sequence
  Motif 7a of Epsin-like polypeptide
SAAS

SEQ ID NO: 57 - protein, 4 aa, Artificial sequence
  Motif 7b of Epsin-like polypeptide
SSAS

SEQ ID NO: 58 - protein, 4 aa, Artificial sequence
  Motif 7c of Epsin-like polypeptide
SSAP

SEQ ID NO: 59 - protein, 4 aa, Artificial sequence
  Motif 7d of Epsin-like polypeptide
SSAT

SEQ ID NO: 60 - protein, 4 aa, Artificial sequence
  Motif 8a of Epsin-like polypeptide
DEFD

SEQ ID NO: 61 - protein, 4 aa, Artificial sequence
  Motif 8b of Epsin-like polypeptide
DFFD

SEQ ID NO: 62 - protein, 4 aa, Artificial sequence
  Motif 8c of Epsin-like polypeptide
DDDF

SEQ ID NO: 63 - protein, 4 aa, Artificial sequence
  Motif  8d of Epsin-like polypeptide
EDDF

SEQ ID NO: 64 - protein, 4 aa, Artificial sequence
  Motif 8e of Epsin-like polypeptide
DDFD

SEQ ID NO: 65 - DNA, 1734 bp, Arabidopsis thaliana
atggatttcatgaaggtcttcgatcaaactgttcgagagataaaaagggaggtgaatctgaaagttttgaaggtccctgagatggagcaaaaggtattggatgctacagataatgagccttggggtccccatggtactgcattggcagagatagctcaggccacgaagaaattctcggagtgccagatggttatgagtgttttgtggactagactaagtgagacaggaaaagattggcgatatgtctacaaggcattggctgttattgattatctgatttcgaatggatcagaacgagcggttgatgagattattgagcatacttaccaaatatcttcactcacaagttttgagtatgttgaaccaaatgggaaagatgtgggaatcaacgtgagaaagaaggcggaaaacatagtcgctcttttaaataataaagagaaaatctcagaaatcagagacaaagcagtagcaaatcgtaacaagtatgttggcctctcatcaacgggaataacatataaatctggttcctcagcttcatttggtggtagttttcaaagtggttcaagcaattttgacagctacaaggatagagattccagagaagacaagaatgactacgagtcttttcaaaagtcaagacgtggtgttaaaactgaggagcaaagctacacttctaagaagagtttttcacgctatggcagcacggaccatgacaatctatccagtggtaaaaagtcacccgattctgccaaacataggtcatatgtatctgcagctccttcaaacaacgatgatgattttgatgattttgatccacggggaacttccagtaatagtatgtttctctctacgactgctgagtttgcagattgtttatcattcattcgggagaaagttggcagtgccaaccaagtggacctttttggaggagatctgattggtgacttcttggattctgggccaacagaaacatcttccaccaacaacaacgagaactttcaagaggcggacttgtttgctgatgcagcttttgtatcagcctcggctcagggagctgaatttgggtcacagacacagaaacaagttgatcttttctctgcgtctgaaccttctgtcacagtttcttcagctcctccgacggttgatctctttgcatcttctgaatcagttgtaagcccagaagccaagatatcaatacctgagtctatggctactcccaacattgttgacccatttgctgcagttcctatggataattttgatggatcagatccttttggtgccttcacttcccactcggcttcagtttctacaggtccacaagctccaagtgtacatgggagtgcaacaaacaccacaagcccgctgtctttcgcagactcgaagccacaacatttgcaaaagaaagatcctttccaggtgaaatcaggaatttgggcagattcgctgagccgtggactgattgatctcaatataactgctcccaaaaaagcttctctagctgatgtgggtgttgtgggggatctgagcaatgaagatgggaacaaagcatctgctgcatcgtactactcaggctggtccatgggtgcaggatccgggcttggtaaaactggcctatacagtacacagcagcagcagcaacaacaacaacaacaacaagcacctgatatctcagacgatttcttctccagcctcagtaaccaaaggtaccaatctggtggctttaagcagtga

SEQ ID NO: 66 - protein, 577 aa, Arabidopsis thaliana
MDFMKVFDQTVREIKREVNLKVLKVPEMEQKVLDATDNEPWGPHGTALAEIAQATKKFSECQMVMSVLWTRLSETGKDWRYVYKALAVIDYLISNGSERAVDEIIEHTYQISSLTSFEYVEPNGKDVGINVRKKAENIVALLNNKEKISEIRDKAVANRNKYVGLSSTGITYKSGSSASFGGSFQSGSSNFDSYKDRDSREDKNDYESFQKSRRGVKTEEQSYTSKKSFSRYGSTDHDNLSSGKKSPDSAKHRSYVSAAPSNNDDDFDDFDPRGTSSNSMFLSTTAEFADCLSFIREKVGSANQVDLFGGDLIGDFLDSGPTETSSTNNNENFQEADLFADAAFVSASAQGAEFGSQTQKQVDLFSASEPSVTVSSAPPTVDLFASSESVVSPEAKISIPESMATPNIVDPFAAVPMDNFDGSDPFGAFTSHSASVSTGPQAPSVHGSATNTTSPLSFADSKPQHLQKKDPFQVKSGIWADSLSRGLIDLNITAPKKASLADVGVVGDLSNEDGNKASAASYYSGWSMGAGSGLGKTGLYSTQQQQQQQQQQQAPDISDDFFSSLSNQRYQSGGFKQ

SEQ ID NO: 67 - DNA, 1686 bp, Vitis vinifera
atggatttcatgaaagtcttcgatcagacggtccgagaaataaagagggaggtgaatctgaaggttttgaaggttccagagatcgagcagaaggtactggatgcaaccgacaatgaaccttggggccctcatggctctgccctggcagaaatagctcaggccactaaaaaattcactgaatgtcagatggttatgaatgttctgtggacaagattaagtgattctggccgagactggcgccatgtctataagtcactggctgttatagagtatttggtggctaatggatctgaacgtgctgttgatgatataattgaacacactttccaaatctcatcactttcaggatttgagtatgttgaaccaaatgggaaggatgttggaatcaatgtgaggaagaaggctgaaaccattgtggctcttttgaataacaaagaaaaaatacaagaagttagaaataaagctgctgcaaaccgcgacaagttctttggactttcctcatctggagtgacatacaagtctagttcagccccatatggcagcagcagctttcagagtgctgatcagcatggaggtatgaaaaatgattcatttagggatagttataaagacagggatcggtttgatgaagaaaaggtcgacgaggatacttctgctaagtcacgtcaaggggttaccagtgagaatgaagggaacacctttaaaaagggatctgcacgctatagcagcaaggataaagatactttgtcaacaaaggcaaattactctgacaagtacgggtcaattccctcccacagttcaagtgtgccttcaattaatgatgaagatgattttgatgactttgatccccggggaacttccagtaccaagaccactgctggaaacattaaccaaccagacctgtttgggcaaagtttgattggtgacctcatggatgcaccggcacctgttcccacagaaatgtctgccatcaacagcaattctgcagagcctgatctgtttgcagatgcaacttttgtttcagcgccacctcatgtagaagaaggttctagttctcaggttgaggcgaaggttgatctatttgggtctcaacctgctggtccttctgcgaatcctccagcatttgacttttttgctgcccctgatccagttgtgcaatcagaaaccaagtctcaaaaatctgacacagccagccccgacattgttgatccatttgctgcagttccactaaacagttttgatggatcagatctttttggttcattcacttcccataccaactctgcatctacagagcctacacaaagtcctgcaaatgatggcaaccttaacaatttgaatggaaaatcctctgcagaatttcaacctccacccaagaaggatgctttccaggttaaatctggaatttgggcagattcactgagccgtggactgattgatcttaatatatccgcacccaagaagataaatctagcagatgttggcattgtgggaggattgagtgatggatcggatgaaagggagaagggaccccaaacttcgttttccatgggacaagccatgggtattggctccggtcttggtaaatctgggtttacatctccaccaacaggtggagttggtggagatgacatcttctcaagtctcggcagccagcaataccaattcggaggcttcaagaaataa

SEQ ID NO: 68 - protein, 561 aa, Vitis vinifera
MDFMKVFDQTVREIKREVNLKVLKVPEIEQKVLDATDNEPWGPHGSALAEIAQATKKFTECQMVMNVLWTRLSDSGRDWRHVYKSLAVIEYLVANGSERAVDDIIEHTFQISSLSGFEYVEPNGKDVGINVRKKAETIVALLNNKEKIQEVRNKAAANRDKFFGLSSSGVTYKSSSAPYGSSSFQSADQHGGMKNDSFRDSYKDRDRFDEEKVDEDTSAKSRQGVTSENEGNTFKKGSARYSSKDKDTLSTKANYSDKYGSIPSHSSSVPSINDEDDFDDFDPRGTSSTKTTAGNINQPDLFGQSLIGDLMDAPAPVPTEMSAINSNSAEPDLFADATFVSAPPHVEEGSSSQVEAKVDLFGSQPAGPSANPPAFDFFAAPDPVVQSETKSQKSDTASPDIVDPFAAVPLNSFDGSDLFGSFTSHTNSASTEPTQSPANDGNLNNLNGKSSAEFQPPPKKDAFQVKSGIWADSLSRGLIDLNISAPKKINLADVGIVGGLSDGSDEREKGPQTSFSMGQAMGIGSGLGKSGFTSPPTGGVGGDDIFSSLGSQQYQFGGFKK

SEQ ID NO: 69 - DNA, 1785 bp, Oryza sativa
atggatttcgtgaaggttttcgatcaggccgtgcgggagataaagagggaggtcaatttgaaggtgctcaaggttccagagctcgaacagaaggtacttgatgcaacaagcgatgaaccttggggccctcatggtactactctttcagagctatcacatgccaccaagaagttcgctgaatgtcagatggtaatgagtgtcctctggactaggctgtctgagcgaggctcgaaatggcgtcacgtgtataaggctttgacaattattgagtacttaatagccaatggttctgagcgggcagttgatgacattcttgatcactattcaaagatctcggttctttcaagttttgaatatgtggaacctaatggaaaagatgctggaataaatgtgagaaagaaagtcgaaactatattgggactcataaatgacaaggagaaaataaagtctgtaagagagaaagccgccagtaatcgtgacaagtatgttgggctatcatcgacagggataacatataagtcaagctctgcttcatttggtagcaactatagttctggtgaacgttatgggagttttagtggtacaagggaaggtgattcatacggtgacagttatagggataaagaacctgttaaatcctctccaagttatactggcagccagaaatctggcagcaggataaaaaaggatgtgaatagaaggaatgaggattcaccgagctccttgaagtctaatgcaaaaggcaatgaggacgattttgatgattttgatcctcgtggatcttcttcaaatggtgcagctaatacaaacaccagtggcgtggatctttttgccccaaacttattggatgatttcatcgatgtgcctgcagcagcaactcatgaaacaaacgactctgcagacgctcaggttgatctgtttgctgatgcagatttccaatcagcaataccaagtacagaaacagctgcgggttcagatgtccagggcaatgtagacctttttgcggaacagccagccttcacagcagcctttccaccacagacagggtttattccaccaccaagttctgggacatctgaagcaaatacttccacgtctaagaacacaactcctgaaccttttgatccttttggtgctattcctataaacagctttgatggatctgatccatttggtgccttcaactccgatgttggatcatctagtataccaccacccacgcagagttctgttggaaatatcagcacaccaagtcagaaccctcaagcagcatctgactttggtggctttgtgtcgagcactgtagaaacagcagctaaggacccctttgatttttcaagtagcaatcttgggaaaacacctttggcagatccaaaggctgatgcatccgattttggtgcctttgtatcgcacagtgaggaagtagccaaggatccttttgatctttctttgagtaccagctctggaaggacaaaccaagcacctctggcggctcccaagtcagataccaagaaagaaaattttcaggtcaagtctggcatatgggctgactcattgagccgtggactgattgatctgaacataactggaccaaagaaggtgaacttagccgacgttgggattgtcggtggcctcgatgacgggtctgatgataaagctctgccctcatggaccatgggtgcaggaggttccagcctaggaatgtccggaattccttcatctacacaaagtggtggcattgagagcttagctaactacaacaagtaccagtttggctttaaatga

SEQ ID NO: 70 - protein, 594 aa, Oryza sativa
MDFVKVFDQAVREIKREVNLKVLKVPELEQKVLDATSDEPWGPHGTTLSELSHATKKFAECQMVMSVLWTRLSERGSKWRHVYKALTIIEYLIANGSERAVDDILDHYSKISVLSSFEYVEPNGKDAGINVRKKVETILGLINDKEKIKSVREKAASNRDKYVGLSSTGITYKSSSASFGSNYSSGERYGSFSGTREGDSYGDSYRDKEPVKSSPSYTGSQKSGSRIKKDVNRRNEDSPSSLKSNAKGNEDDFDDFDPRGSSSNGAANTNTSGVDLFAPNLLDDFIDVPAAATHETNDSADAQVDLFADADFQSAIPSTETAAGSDVQGNVDLFAEQPAFTAAFPPQTGFIPPPSSGTSEANTSTSKNTTPEPFDPFGAIPINSFDGSDPFGAFNSDVGSSSIPPPTQSSVGNISTPSQNPQAASDFGGFVSSTVETAAKDPFDFSSSNLGKTPLADPKADASDFGAFVSHSEEVAKDPFDLSLSTSSGRTNQAPLAAPKSDTKKENFQVKSGIWADSLSRGLIDLNITGPKKVNLADVGIVGGLDDGSDDKALPSWTMGAGGSSLGMSGIPSSTQSGGIESLANYNKYQFGFK

SEQ ID NO: 71 - DNA, 1887 bp, Oryza sativa
atggatttcaggaaggtgctcgaccagaccgtccgggagataaggagggaggtaaatcttaaggtgctcaaggtgccggaaatcgagcagaaggttcttgatgccaccagcgacgagccgtgggggccgcatggttccgatttggcagatatcgccagggccaccaagagctacggtgatagcgaaattataatgaatgtgttatggcaacgcctggggaacacacttgcgaattggcgtcacgtgtataaggcgttggctgtgatcgagtaccttctagctaatggcaccgaacgtgcagctgatggcattgttgacaatagctcacgaattgcaaaactcacaagatttgagtatttggagcctaatggaaaagatgttgggctcaatgtgcgtaagaaggctgaagctgttctagcaattttggatgacagggagaagcttcaagaggtcagagagaaggctgccgttactagagacaagtattttggcttatcatcaactggaataacgcacaaatcgagcgcagcatcatttggcagtggcagctactcatctggtagccactatgggagcacaggaggttcaagggaggtgggatcattcaaggatatacacacaggcacagaatggaaaaagaacaagaaggaaacagtgtcaaactacagcagcaatagagaagggtctaaagaaattactaacagtgcaaccagttataagtcaaaaaagagtgaaaggcatggtagaagaaatcaaaattccttaacattacactcgaagttatctgcaaatattagcaccacatctgaagccccaagctcaaagaaaggggaaaatgaggatgatgatgatttcaacccacgaggattttctacatctactggaacaggtaccacaagatctaatcacctggatctctttggtccaagcttgatggatgatcttgttgattctactacatccacttcaacagcaacgccaaatgttagcacacctgctgtgccagaggttgatttatttgcagatgcagctttccaatcagccaatgctccattggaggcagcaacggtttctcacactcaggacaaaattgatttgtttgctggcagactgtcttctgctgattcatttacttcagacacagagttctcagtacgcggtagtcctaacaagtcatcggagaaaaaaatgtcttccgttgtgcatccttctacttctgcttttgatcccttcaaacaatcttttgccacctcatttccttcagattcagagttctcagttcatgatccgacaagcaaatcttctcaaggaaaaactcccacaccagaacattcaagtacagcagcttttgatccttttgctgcaattccactgaagagttttgatggatccgaatcttttggaacattttcttcgaacacagcctcaaacattactgaactgccacgggattcttctgggggtcccaaaagttctgaccatggtcctttggaggatgccaattttgatgccttcacttcacacttgggatcttccacaacaagtgcaactgagtccatgaataagcccatcaaaaagcttgggcaggactcgatgtcagcatcaaaatcagttgcaaagaaagaaacttttcaggtcaaatctggcatatgggctgactctttgagccgaggattgattgatttgaatataacttcgtcacaaaagaaggtcgatctctccgatgttgggattgtcggaccgctgagcggcggatctgaggataaaggcccgggggcgacgatgggcacagcaccaggccttgtcagttctagttttccatctaaaacagaaacatccagtggaagcggtcattttcagcaccaacagtttggaagctttaagtga

SEQ ID NO: 72 - protein, 628 aa, Oryza sativa
MDFRKVLDQTVREIRREVNLKVLKVPEIEQKVLDATSDEPWGPHGSDLADIARATKSYGDSEIIMNVLWQRLGNTLANWRHVYKALAVIEYLLANGTERAADGIVDNSSRIAKLTRFEYLEPNGKDVGLNVRKKAEAVLAILDDREKLQEVREKAAVTRDKYFGLSSTGITHKSSAASFGSGSYSSGSHYGSTGGSREVGSFKDIHTGTEWKKNKKETVSNYSSNREGSKEITNSATSYKSKKSERHGRRNQNSLTLHSKLSANISTTSEAPSSKKGENEDDDDFNPRGFSTSTGTGTTRSNHLDLFGPSLMDDLVDSTTSTSTATPNVSTPAVPEVDLFADAAFQSANAPLEAATVSHTQDKIDLFAGRLSSADSFTSDTEFSVRGSPNKSSEKKMSSVVHPSTSAFDPFKQSFATSFPSDSEFSVHDPTSKSSQGKTPTPEHSSTAAFDPFAAIPLKSFDGSESFGTFSSNTASNITELPRDSSGGPKSSDHGPLEDANFDAFTSHLGSSTTSATESMNKPIKKLGQDSMSASKSVAKKETFQVKSGIWADSLSRGLIDLNITSSQKKVDLSDVGIVGPLSGGSEDKGPGATMGTAPGLVSSSFPSKTETSSGSGHFQHQQFGSFK

SEQ ID NO: 73 - DNA, 1917 bp, Avena fatua
atggatttcatgaaggtcttcgatcagaccgtgcgagagatcaagagggaggtcaacctgaaggtgctcaaggttcccgagctcgaacagaaggtgcttgatgcaacaagtgatgaaccttggggtccacatggaagtgctctttcagacgtagcgcaggccaccaagaaatactctgagtgtcagatggtaatgggtgtcctttgggctaggcttgctgagcgagactcgaactggcgccatgtgtataaggcgctgacaattatcgagtacttgatagccaacggttctgagcgggcggttgataacatccttgatcatttttcaaagatctcggttctttcgagttttgagtttgtggaaccgaatggaaaagatgctggaataaatgtgaggaagaaagtcgaaactctagtgggcatcataaatgacaaggatagaataaaggctgtgagagataaagcagccagtaaccgtgacaagtacgttgggttatcctcaaccggatcatcatatagatcaagctcagccactgtagggagcaattacagttcaggtgaacgttatgggagttttggtggcacaagggagggtgattcgttcagcaacagttacaaggacaaagaatctgctaaaacctctgcaggtagtaatggcagcaagaaatctggcagcaagacaagaaaagatgcgaagcatgatagaagctcctcgaagccaccatctactgcaaaaagcaatgaagatgacttcgatgactttgatccccgtggatcttcttcaaatgatgcagctaacaatgcgaagactagcgaggtcgatctttttggcccaaacttgatggatgatttcatggatgagcctgcagccactccagcaacaaaaggtgttgtagaacctcaggttgatctatttggtgatgcagatttccaatcagcaaccccaagtgcagaaactgctgcgcatcaggatgtccaggacaatgttgacctttttgcgggaaatgcaacctttgcttcagcatttccatcacagacggggtttattccaccaccaagttccgggacatcttcttctgccaatagttttgtgtccaagaagacagtacctgaaccatttgatcctttcggtgatattcctttaagcagttttggaggatctgacccatttggtgacttcagttccaatgttggatcatctactgcaccgccagctgtacacaattccactggaaatatcagcacgccgagtcagaactctcaggcagcatcagactttggcgcctttgaatctaacaccggaggcgcagctaaagatccctttgatttttcttccggtggcaattttggcaaaacaaacgtaacacctttggcagctcccaaaaccgacacgtctgatttcggtgcattcgtagcaaacactgcggaacgtgctaaggacccctttgatctttcttctagcatcaacaatggaaggacaggccaaacacctctggcagctcccaagtctaacaccaagaaagaaaatctccaggtcaaatctagcatatgggccgactctttgagccgtggattgattgatctgaacataaccggaccaaagaaggtgaacttggccgacgttgggatcgtgggcggcctcggtgatgggtcagatgacaaggctcatcagccctcctggaacatgggcggcggggggatctggtctagggatgtctggaatccctccatctacacaaggcggcggcatcgagagcttggcgaactacaacaagtaccagtttggcttcaaatgagcgttcaggcgagagcgtttgtagtattctggtgctcttgttgccgggctgttaaatgcatattgatttcttttcttttgttatatacatctgttctggtgatttcattatgttacctgtaa

SEQ ID NO: 74 - protein, 638 aa, Avena fatua
MDFMKVFDQTVREIKREVNLKVLKVPELEQKVLDATSDEPWGPHGSALSDVAQATKKYSECQMVMGVLWARLAERDSNWRHVYKALTIIEYLIANGSERAVDNILDHFSKISVLSSFEFVEPNGKDAGINVRKKVETLVGIINDKDRIKAVRDKAASNRDKYVGLSSTGSSYRSSSATVGSNYSSGERYGSFGGTREGDSFSNSYKDKESAKTSAGSNGSKKSGSKTRKDAKHDRSSSKPPSTAKSNEDDFDDFDPRGSSSNDAANNAKTSEVDLFGPNLMDDFMDEPAATPATKGVVEPQVDLFGDADFQSATPSAETAAHQDVQDNVDLFAGNATFASAFPSQTGFIPPPSSGTSSSANSFVSKKTVPEPFDPFGDIPLSSFGGSDPFGDFSSNVGSSTAPPAVHNSTGNISTPSQNSQAASDFGAFESNTGGAAKDPFDFSSGGNFGKTNVTPLAAPKTDTSDFGAFVANTAERAKDPFDLSSSINNGRTGQTPLAAPKSNTKKENLQVKSSIWADSLSRGLIDLNITGPKKVNLADVGIVGGLGDGSDDKAHQPSWNMGGGGIWSRDVWNPSIYTRRRHRELGELQQVPVWLQMSVQARAFVVFWCSCCRAVKCILISFLLLYTSVLVISLCYL

SEQ ID NO: 75 - DNA, 2910 bp, Medicago truncatula
atgaagaaggtttttggtcaaactgttagggaccttaaaagagaagtgaacaagaaagtgctcaaagttcctggcattgaacagaaggttcttgatgctactagcaatgaaccatggggtcctcatggaacactgcttgcagacattgctcaggcaactagaaaccctcatgaataccagatgatcatgtcagtagtctggaaacgaattaacgacactggcaagaattggcggcatgtctacaaggctttgacagtacttgagtacttggtggcccatggttctgagagagtcatagatgagatcaaagaacattcttatcaaatatcgactttgtccgactttcaatatattgattccagtggaagagatcaaggaaacaatgtcaggaaaaaatctcagaatctcgttgtccttgtgaatgataaagaaagaatcgtagaagttagacagaaggctgctgttaatagggaaaagtttcgcaataacacaccaggaggaatgtatagacctggttcacactcaagcattggaagctatggtgatcgatatgaagaagatcgttatgcgaacagggaggaagatagaaatggctatggttatggaagagaaagagaaatgggctctagagatgatgatcggtacaatcgcgatggggatcgttatggtagagattatgaggaacgttatggtagggacggttacagagatgatgataggggaagaagtcgaagtgttgactataattatgatgatactaggagcaggaattctgatagagatcgtgatttcgatgacgatggccaacactcgtctcgaggtagcaatgctaaagttgaagaccaatcactggaagcaagacttcagcggaaactttctgagcaaaattcgggtgctcctcctagttatgaagaggctgttggtgaagctcagagccctgtgcctgaaagggatgttgaaacttcggcagaatctgctccaagaggctcgtcccctcatgcaagtgataatcctagcccagcctctgctcctactggatcttctcctgtaagcaataatccaactgaagtaactgctgctgccagtacatctgttgctgctagtactgctgcttctacccaggaaactgagcccactgatgatttctttgacccacgtggtcctacatcagctgctccaaccacctctaattttggcgaaatagatttgctcggttctttatcagactcattctcttcaaacgctctgcctcttgtgcccgctacatcaggaatttcaacccctgaagcaaacactggttcaacagcttcttttgcagcaccatcctctgggtccaataatttcaatcagtcttttgaagatccgtttggtgattcaccattcaaggctgatacttctgttgaaactgctccatctcaacaccatgcacctcagactactgaaccatcccaatcagatggttttaatgctgacatgtctaactttgggtttggggactcattttctattgtaccatactctgcatctgctcccagtgacactcaacctttctctgctaactcccagtttttgtcccaagattcggaaactgatattctagctgacattcttcctcctgcaccattacctgagattacatcacagcagaacagttcagctccttcttttggccaaccttcaccttccttttcaacttcatctggatcattttccgaaccaactggtcaacttactcttcatcaaggtttctcagctgcaaccaatcaacctgcacaaacccttccaactggtcaattttcgcagccaggcttttcagcttctaattcatctttttcagcctctaccagtccatatgcacagcaaccttttccttctcattctggtcaacctggcatgcctgggttttcgtcatctactggacattctatgcagccaccttttgcttctcaaggcggtcaatctactgcacaaacaagcggtcatacctacggtggattgtactccctggatacatctcttactccaggagctccaaacatgtattctcaatcacaaaatggatataacggatctatgaacagtgggaactacttgccacagggatcctcaacaggctttccttcacaaatgactccccaagctccaacagcacaaccggcacaaatcacaaactttccccatcatggaggatctactgcttctccctctccaactgatcaagcatcacagttcaacaaccagagcttctttggacaacaagggaatgcagctccctttagctcatcatatacccctcaagtgcctgctcccaatgcttcgccgtatgctgtttcagcggcaccaaattctttagtttctcaaccatccaaagataagtttgaaacaaaatcaacagtttgggcagacacattaagcaggggactggttaatttaaacatatctggacctaaaactaatccattagcagatattggcattgacttcgaatccattaataggaaggaaaagagaatggagaagcccactaacacacctgtaacatcaactgtaaatatgggtaaagctatgggatcaggttcaggcataggtcgtgctggcgctggtgctcttagacctaatccaaattcgatgatgggttctggtatgggcatgggtatgggaatgggcaatgctcccggtggtatgggtatgggcaatgctcccggtggtatgggtatgggaggttacggaggaggcatgaatccatccatgggtatgggtatgggtatggggggaatgggcatggggcaaggataccagatgcaacctcctaatggaatgcctcctggttccaacatgccaggtaactataataataacatgatgcgtccaggtggttatgctcaacagccatatggtggataccgatga

SEQ ID NO: 76 - protein, 969 aa, Medicago truncatula
MKKVFGQTVRDLKREVNKKVLKVPGIEQKVLDATSNEPWGPHGTLLADIAQATRNPHEYQMIMSVVWKRINDTGKNWRHVYKALTVLEYLVAHGSERVIDEIKEHSYQISTLSDFQYIDSSGRDQGNNVRKKSQNLVVLVNDKERIVEVRQKAAVNREKFRNNTPGGMYRPGSHSSIGSYGDRYEEDRYANREEDRNGYGYGREREMGSRDDDRYNRDGDRYGRDYEERYGRDGYRDDDRGRSRSVDYNYDDTRSRNSDRDRDFDDDGQHSSRGSNAKVEDQSLEARLQRKLSEQNSGAPPSYEEAVGEAQSPVPERDVETSAESAPRGSSPHASDNPSPASAPTGSSPVSNNPTEVTAAASTSVAASTAASTQETEPTDDFFDPRGPTSAAPTTSNFGEIDLLGSLSDSFSSNALPLVPATSGISTPEANTGSTASFAAPSSGSNNFNQSFEDPFGDSPFKADTSVETAPSQHHAPQTTEPSQSDGFNADMSNFGFGDSFSIVPYSASAPSDTQPFSANSQFLSQDSETDILADILPPAPLPEITSQQNSSAPSFGQPSPSFSTSSGSFSEPTGQLTLHQGFSAATNQPAQTLPTGQFSQPGFSASNSSFSASTSPYAQQPFPSHSGQPGMPGFSSSTGHSMQPPFASQGGQSTAQTSGHTYGGLYSLDTSLTPGAPNMYSQSQNGYNGSMNSGNYLPQGSSTGFPSQMTPQAPTAQPAQITNFPHHGGSTASPSPTDQASQFNNQSFFGQQGNAAPFSSSYTPQVPAPNASPYAVSAAPNSLVSQPSKDKFETKSTVWADTLSRGLVNLNISGPKTNPLADIGIDFESINRKEKRMEKPTNTPVTSTVNMGKAMGSGSGIGRAGAGALRPNPNSMMGSGMGMGMGMGNAPGGMGMGNAPGGMGMGGYGGGMNPSMGMGMGMGGMGMGQGYQMQPPNGMPPGSNMPGNYNNNMMRPGGYAQQPYGGYR

SEQ ID NO: 77 - DNA, 2688 bp, Arabidopsis thaliana
atgaagaaagtcttcggacaaactgttagagaccttaagagagaggtcaacaagaaagtgctcaaagttcctggagtagaacagaaggttctagatgctactagtaatgagccatggggtccacatggatcacttcttgctgatcttgcgcaagcttccagaaattatcatgaatatcagctgatcatggtggtcatatggaaacgccttagcgacaccggaaaaaactggcggcatgtctataaggctttgacagttttggagtacatggtaggccatggatcagaacgtgttatagacgagattagagaacgtgcatatcaaatttcgacattgtccgattttcagtatattgattccggtggtagagatcaaggaagcaatgttaggaagaaatcacagagcctggtggctttggtgaatgacaaggaaagaatagctgaagtcagacagaaggctgctgctaatagagataagtatcgcagctcagcaccaggtgggatgtataagccttcaggcggatatggggataaatatgattacggaagccgggatgaagagcgaagtagttatggaagagaaagagaatatggttacagagatgatgatagaaatagtcgtgatggagatcgtcattccagggactctgaagaccggtatgggagagatggtaatagggatgatgattacaggggaaggagcagaagtgttgataactatgggtcacgaggtaggagttcggaaagagagcgggaggatgatggccattcttcatcacggggcagtggtgctcgagctgatgataattctcaggatgggagaggggggctccagaggaagttttctgaacaaaatattggcgctccacccaattatgaagaagctgtcagtgattcacgcagccctgtatatagtgaaagggatggtggggagaccccacaagttaccgctccaggagctgcttctcctcctcccccacaagttgctgctccagaggctgcttctcctccaactggaaccaacacagccaatacaactgctacttttgttaatgaatcaccttctcagaaagttgagactttcgatgaatttgatccacgcagtgcgttttcagctggccctccagcatatgcatctacagatggtgttacagctcctccaactgtgacttctatgtctgcccctaccacctcaaacagtgttgagatggacttgcttggttcccttgcagacgtattttcatcaaacgcattggccattgtaccagctgattctatctatgttgaaaccaatggacaagcaaacgctggtccagctccatcgttttctacatctcagccatcaactcagtcatttgatgacccatttggtgactctcctttcaaggccttcacttctactgacaccgactcaaccccacagcagaattttggagcttctttccagccaccacctccagccttcacttcagaggtctcacatcctgatactgctcataactttggctttggggactcattttccgccgttgccaatcctgatcctgcttctcagaatgtgcaacctccatcgaactcaccaggttttcctcaagagcaatttgctacatctcagagtggtattgatatcctcgctggcattctcccaccatctggacctccagtacaatcgggtccctcaataccaacatctcaatttcctcccagtggaaacaacatgtacgagggatttcattctcagccgccggtatctacagctccaaacctgcctggacaaactccatttggacaagctgttcaaccatataacatggttcctcattctcaaaatatgactggagccatgccatttaatagtggaggcttcatgcaccagccgggctcacaaactccttactctaccccaagtggaccagctggtcagttcatggcacaccaaggtcatggaatgccgccatcccatggtccacaacgaactcaatccggacctgttactctgcaagggaacaacaatgtcatgggagacatgttctcgcaagctacgcccaactccttgacgtcatcatcatctcatccagatctcacacctttaacaggagcaattgagattgttcctccgcctcagaaaaagtttgagccaaaatcatcagtctgggcagacacgttgagcagggggcttgttaactttaacatatctggatctaaaacaaatccattggcagacataggagttgacttcgaggcgatcaacaggagagagaaacggctggagaaacaaacaaacacaccagcaacatcgactatcaatatgggtaaagccatgggatcaggcactggcttagggcgttctggtgcaactgctatgagacctccacctaatccaatgacaggctctggcatgcccatgggcggaggaatgggtgttggtagctacggaggtatgaaccagaaccaacccatgggtatgggtatgggggccggaatgaaccaaaaccaaccgatgggtatgggaatgggacccggcatgaacatgaacatgaacatgggaggatatggccaaggctatccgatgcaaccacaaaacccagggatggtacctagcccaaacatgcctggcaataactacaatccgatgatgggtcaaggtggttacaaccctcaacaatcctatggtggtggataccggtaa

SEQ ID NO: 78 - protein, 895 aa, Arabidopsis thaliana
MKKVFGQTVRDLKREVNKKVLKVPGVEQKVLDATSNEPWGPHGSLLADLAQASRNYHEYQLIMVVIWKRLSDTGKNWRHVYKALTVLEYMVGHGSERVIDEIRERAYQISTLSDFQYIDSGGRDQGSNVRKKSQSLVALVNDKERIAEVRQKAAANRDKYRSSAPGGMYKPSGGYGDKYDYGSRDEERSSYGREREYGYRDDDRNSRDGDRHSRDSEDRYGRDGNRDDDYRGRSRSVDNYGSRGRSSEREREDDGHSSSRGSGARADDNSQDGRGGLQRKFSEQNIGAPPNYEEAVSDSRSPVYSERDGGETPQVTAPGAASPPPPQVAAPEAASPPTGTNTANTTATFVNESPSQKVETFDEFDPRSAFSAGPPAYASTDGVTAPPTVTSMSAPTTSNSVEMDLLGSLADVFSSNALAIVPADSIYVETNGQANAGPAPSFSTSQPSTQSFDDPFGDSPFKAFTSTDTDSTPQQNFGASFQPPPPAFTSEVSHPDTAHNFGFGDSFSAVANPDPASQNVQPPSNSPGFPQEQFATSQSGIDILAGILPPSGPPVQSGPSIPTSQFPPSGNNMYEGFHSQPPVSTAPNLPGQTPFGQAVQPYNMVPHSQNMTGAMPFNSGGFMHQPGSQTPYSTPSGPAGQFMAHQGHGMPPSHGPQRTQSGPVTLQGNNNVMGDMFSQATPNSLTSSSSHPDLTPLTGAIEIVPPPQKKFEPKSSVWADTLSRGLVNFNISGSKTNPLADIGVDFEAINRREKRLEKQTNTPATSTINMGKAMGSGTGLGRSGATAMRPPPNPMTGSGMPMGGGMGVGSYGGMNQNQPMGMGMGAGMNQNQPMGMGMGPGMNMNMNMGGYGQGYPMQPQNPGMVPSPNMPGNNYNPMMGQGGYNPQQSYGGGYR

SEQ ID NO: 79 - DNA, 2688 bp, Arabidopsis thaliana
atgaagaaagtcttcggacaaactgttagagaccttaagagagaggtcaacaagaaagtgctcaaagttcctggagtagaacagaaggttctagatgctactagtaatgagccatggggtccacatggatcacttcttgctgatcttgcgcaagcttccagaaattatcatgaatatcagctgatcatggtggtcatatggaaacgccttagcgacaccggaaaaaactggcggcatgtctataaggctttgacagttttggagtacatggtaggccatggatcagaacgtgttatagacgagattagagaacgtgcatatcaaatttcgacattgtccgattttcagtatattgattccggtggtagagatcaaggaagcaatgttaggaagaaatcacagagcctggtggctttggtgaatgacaaggaaagaatagctgaagtcagacagaaggctgctgctaatagagataagtatcgcagctcagcaccaggtgggatgtataagccttcaggcggatatggggataaatatgattacggaagccgggatgaagagcgaagtagttatggaagagaaagagaatatggttacagagatgatgatagaaatagtcgtgatggagatcgtcattccagggactctgaagaccggtatgggagagatggtaatagggatgatgattacaggggaaggagcagaagtgttgataactatgggtcacgaggtaggagttcggaaagagagcgggaggatgatggccattcttcatcacggggcagtggtgctcgagctgatgataattctcaggatgggagaggggggctccagaggaagttttctgaacaaaatattggcgctccacccagttatgaagaagctgtcagtgattcacgcagccctgtatatagtgaaagggatggtggggagaccccacaagttaccgctccaggagctgcttctcctcctcccccacaagttgctgctccagaggctgcttctcctccaactggaaccaacacagccaatacaactgctacttttgttaatgaatcaccttctcagaaagttgagactttcgatgaatttgatccacgcagtgcgttttcagctggccctccagcatatgcatctacagatggtgttacagctcctccaactgtgacttctatgtctgcccctaccacctcaaacagtgttgagatggacttgcttggttcccttgcagacgtattttcatcaaacgcattggccattgtaccagctgattctatctatgttgaaaccaatggacaagcaaacgctggtccagctccatcgttttctacatctcagccatcaactcagtcatttgatgacccatttggtgactctcctttcaaggccttcacttctactgacaccgactcaaccccacagcagaattttggagcttctttccagccaccacctccagccttcacttcagaggtctcacatcctgatactgctcataactttggctttggggactcattttccgccgttgccaatcctgatcctgcttctcagaatgtgcaacctccatcgaactcaccaggttttcctcaagagcaatttgctacatctcagagtggtattgatatcctcgctggcattctcccaccatctggacctccagtacaatcgggtccctcaataccaacatctcaatttcctcccagtggaaacaacatgtacgagggatttcattctcagccgccggtatctacagctccaaacctgcctggacaaactccatttggacaagctgttcaaccatataacatggttcctcattctcaaaatatgactggagccatgccatttaatagtggaggcttcatgcaccagccgggctcacaaactccttactctaccccaagtggaccagctggtcagttcatggcacaccaaggtcatggaatgccgccatcccatggtccacaacgaactcaatccggacctgttactctgcaagggaacaacaatgtcatgggagacatgttctcgcaagctacgcccaactccttgacgtcatcatcatctcatccagatctcacacctttaacaggagcaattgagattgttcctccgcctcagaaaaagtttgagccaaaatcatcagtctgggcagacacgttgagcagggggcttgttaactttaacatatctggatctaaaacaaatccattggcagacataggagttgacttcgaggcgatcaacaggagagagaaacggctggagaaacaaacaaacacaccagcaacatcgactatcaatatgggtaaagccatgggatcaggcactggcttagggcgttctggtgcaactgctatgagacctccacctaatccaatgacaggctctggcatgcccatgggcggaggaatgggtgttggtagctacggaggtatgaaccagaaccaacccatgggtatgggtatgggggccggaatgaaccaaaaccaaccgatgggtatgggaatgggacccggcatgaacatgaacatgaacatgggaggatatggccaaggctatccgatgcaaccacaaaacccagggatggtacctagcccaaacatgcctggcaataactacaatccgatgatgggtcaaggtggttacaaccctcaacaatcctatggtggtggataccggtaa

SEQ ID NO: 80 - protein, 895 aa, Arabidopsis thaliana
MKKVFGQTVRDLKREVNKKVLKVPGVEQKVLDATSNEPWGPHGSLLADLAQASRNYHEYQLIMVVIWKRLSDTGKNWRHVYKALTVLEYMVGHGSERVIDEIRERAYQISTLSDFQYIDSGGRDQGSNVRKKSQSLVALVNDKERIAEVRQKAAANRDKYRSSAPGGMYKPSGGYGDKYDYGSRDEERSSYGREREYGYRDDDRNSRDGDRHSRDSEDRYGRDGNRDDDYRGRSRSVDNYGSRGRSSEREREDDGHSSSRGSGARADDNSQDGRGGLQRKFSEQNIGAPPSYEEAVSDSRSPVYSERDGGETPQVTAPGAASPPPPQVAAPEAASPPTGTNTANTTATFVNESPSQKVETFDEFDPRSAFSAGPPAYASTDGVTAPPTVTSMSAPTTSNSVEMDLLGSLADVFSSNALAIVPADSIYVETNGQANAGPAPSFSTSQPSTQSFDDPFGDSPFKAFTSTDTDSTPQQNFGASFQPPPPAFTSEVSHPDTAHNFGFGDSFSAVANPDPASQNVQPPSNSPGFPQEQFATSQSGIDILAGILPPSGPPVQSGPSIPTSQFPPSGNNMYEGFHSQPPVSTAPNLPGQTPFGQAVQPYNMVPHSQNMTGAMPFNSGGFMHQPGSQTPYSTPSGPAGQFMAHQGHGMPPSHGPQRTQSGPVTLQGNNNVMGDMFSQATPNSLTSSSSHPDLTPLTGAIEIVPPPQKKFEPKSSVWADTLSRGLVNFNISGSKTNPLADIGVDFEAINRREKRLEKQTNTPATSTINMGKAMGSGTGLGRSGATAMRPPPNPMTGSGMPMGGGMGVGSYGGMNQNQPMGMGMGAGMNQNQPMGMGMGPGMNMNMNMGGYGQGYPMQPQNPGMVPSPNMPGNNYNPMMGQGGYNPQQSYGGGYR

SEQ ID NO: 81 - DNA, 1941 bp, Arabidopsis thaliana
atgaagaaagtcttcggacaaactgttagagaccttaagagagaggtcaacaagaaagtgctcaaagttcctggagtagaacagaaggttctagatgctactagtaatgagccatggggtccacatggatcacttcttgctgatcttgcgcaagcttccagaaattatcatgaatatcagctgatcatggtggtcatatggaaacgccttagcgacaccggaaaaaactggcggcatgtctataaggctttgacagttttggagtacatggtaggccatggatcagaacgtgttatagacgagattagagaacgtgcatatcaaatttcgacattgtccgattttcagtatattgattccggtggtagagatcaaggaagcaatgttaggaagaaatcacagagcctggtggctttggtgaatgacaaggaaagaatagctgaagtcagacagaaggctgctgctaatagagataagtatcgcagctcagcaccaggtgggatgtataagccttcaggcggatatggggataaatatgattacggaagccgggatgaagagcgaagtagttatggaagagaaagagaatatggttacagagatgatgatagaaatagtcgtgatggagatcgtcattccagggactctgaagaccggtatgggagagatggtaatagggatgatgattacaggggaaggagcagaagtgttgataactatgggtcacgaggtaggagttcggaaagagagcgggaggatgatggccattcttcatcacggggcagtggtgctcgagctgatgataattctcaggatgggagaggggggctccagaggaagttttctgaacaaaatattggcgctccacccagttatgaagaagctgtcagtgattcacgcagccctgtatatagtgaaagggatggtggggagaccccacaagttaccgctccaggagctgcttctcctcctcccccacaagttgctgctccagaggctgcttctcctccaactggaaccaacacagccaatacaactgctacttttgttaatgaatcaccttctcagaaagttgagactttcgatgaatttgatccacgcagtgcgttttcagctggccctccagcatatgcatctacagatggtgttacagctcctccaactgtgacttctatgtctgcccctaccacctcaaacagtgttgagatggacttgcttggttcccttgcagacgtattttcatcaaacgcattggccattgtaccagctgattctatctatgttgaaaccaatggacaagcaaacgctggtccagctccatcgttttctacatctcagccatcaactcagtcatttgatgacccatttggtgactctcctttcaaggccttcacttctactgacaccgactcaaccccacagcagaattttggagcttctttccagccaccacctccagccttcacttcagaggtctcacatcctgatactgctcataactttggctttggggactcattttccgccgttgccaatcctgatcctgcttctcagaatgtgcaacctccatcgaactcaccaggttttcctcaagagcaatttgctacatctcagagtggtattgatatcctcgctggcattctcccaccatctggacctccagtacaatcgggtccctcaataccaacatctcaatttcctcccagtggaaacaacatgtacgaggggtttcattctcagccgccggtatctacagctccaaacctgcctggacaaactccatttggacaagctgttcaaccatataacatggttcctcattctcaaaatatgactggagccatgccatttaatagtggaggcttcatgcaccagccgggctcacaaactccttactctaccccaagtggaccagctggtcagttcatggcactggcttag

SEQ ID NO: 82 - protein, 646 aa, Arabidopsis thaliana
MKKVFGQTVRDLKREVNKKVLKVPGVEQKVLDATSNEPWGPHGSLLADLAQASRNYHEYQLIMVVIWKRLSDTGKNWRHVYKALTVLEYMVGHGSERVIDEIRERAYQISTLSDFQYIDSGGRDQGSNVRKKSQSLVALVNDKERIAEVRQKAAANRDKYRSSAPGGMYKPSGGYGDKYDYGSRDEERSSYGREREYGYRDDDRNSRDGDRHSRDSEDRYGRDGNRDDDYRGRSRSVDNYGSRGRSSEREREDDGHSSSRGSGARADDNSQDGRGGLQRKFSEQNIGAPPSYEEAVSDSRSPVYSERDGGETPQVTAPGAASPPPPQVAAPEAASPPTGTNTANTTATFVNESPSQKVETFDEFDPRSAFSAGPPAYASTDGVTAPPTVTSMSAPTTSNSVEMDLLGSLADVFSSNALAIVPADSIYVETNGQANAGPAPSFSTSQPSTQSFDDPFGDSPFKAFTSTDTDSTPQQNFGASFQPPPPAFTSEVSHPDTAHNFGFGDSFSAVANPDPASQNVQPPSNSPGFPQEQFATSQSGIDILAGILPPSGPPVQSGPSIPTSQFPPSGNNMYEGFHSQPPVSTAPNLPGQTPFGQAVQPYNMVPHSQNMTGAMPFNSGGFMHQPGSQTPYSTPSGPAGQFMALA

SEQ ID NO: 83 - DNA, 2688 bp, Arabidopsis thaliana
atgaagaaagtcttcggacaaactgttagagaccttaagagagaggtcaacaagaaagtgctcaaagttcctggagtagaacagaaggttctagatgctactagtaatgagccatggggtccacatggatcacttcttgctgatcttgcgcaagcttccagaaattatcatgaatatcagctgatcatggtggtcatatggaaacgccttagcgacaccggaaaaaactggcggcatgtctataaggctttgacagttttggagtacatggtaggccatggatcagaacgtgttatagacgagattagagaacgtgcatatcaaatttcgacattgtccgattttcagtatattgattccggtggtagagatcaaggaagcaatgttaggaagaaatcacagagcctggtggctttggtgaatgacaaggaaagaatagctgaagtcagacagaaggctgctgctaatagagataagtatcgcagctcagcaccaggtgggatgtataagccttcaggcggatatggggataaatatgattacggaagccgggatgaagagcgaagtagttatggaagagaaagagaatatggttacagagatgatgatagaaatagtcgtgatggagatcatcattccagggactctgaagaccggtatgggagagatggtaatagggatgatgattacaggggaaggagcagaagtgttgataactatgggtcacgaggtaggagttcggaaagagagcgggaggatgatggccattcttcatcacggggcagtggtgctcgagctgatgataattctcaggatgggagaggggggctccagaggaagttttctgaacaaaatattggcgctccacccagttatgaagaagctgtcagtgattcacgcagccctgtatatagtgaaagggatggtggggagaccccacaagttaccgctccaggagctgcttctcctcctcccccacaagttgctgctccagaggctgcttctcctccaactggaaccaacacagccaatacaactgctacttttgttaatgaatcaccttctcagaaagttgagactttcgatgaatttgatccacgcagtgcgttttcagctggccctccagcatatgcatctacagatggtgttacagctcctccaactgtgacttctatgtctgcccctaccacctcaaacagtgttgagatggacttgcttggttcccttgcagacgtattttcatcaaacgcattggccattgtaccagctgattctatctatgttgaaaccaatggacaagcaaacgctggtccagctccatcgttttctacatctcagccatcaactcagtcatttgatgacccatttggtgactctcctttcaaggccttcacttctactgacaccgactcaaccccacagcagaattttggagcttctttccagccaccacctccagccttcacttcagaggtctcacatcctgatactgctcataactttggctttggggactcattttccgccgttgccaatcctgatcctgcttctcagaatgtgcaacctccatcgaactcaccaggttttcctcaagagcaatttgctacatctcagagtggtattgatatcctcgctggcattctcccaccatctggacctccagtacaatcgggtccctcaataccaacatctcaatttcctcccagtggaaacaacatgtacgagggatttcattctcagccgccggtatctacagctccaaacctgcctggacaaactccatttggacaagctgttcaaccatataacatggttcctcattctcaaaatatgactggagccatgccatttaatagtggaggcttcatgcaccagccgggctcacaaactccttactctaccccaagtggaccagctggtcagttcatggcacaccaaggtcatggaatgccgccatcccatggtccacaacgaactcaatccggacctgttactctgcaagggaacaacaatgtcatgggagacatgttctcgcaagctacgcccaactccttgacgtcatcatcatctcatccagatctcacacctttaacaggagcaattgagattgttcctccgcctcagaaaaagtttgagccaaaatcatcagtctgggcagacacgttgagcagggggcttgttaactttaacatatctggatctaaaacaaatccattggcagacataggagttgacttcgaggcgatcaacaggagagagaaacggctggagaaacaaacaaacacaccagcaacatcgactatcaatatgggtaaagccatgggatcaggcactggcttagggcgttctggtgcaactgctatgagacctccacctaatccaatgacaggctctggcatgcccatgggcggaggaatgggtgttggtagctacggaggtatgaaccagaaccaacccatgggtatgggtatgggggccggaatgaaccaaaaccaaccgatgggtatgggaatgggacccggcatgaacatgaacatgaacatgggaggatatggccaagactatccgatgcaaccacaaaacccagggatggtacctagcccaaacatgcctggcaataactacaatccgatgatgggtcaaggtggttacaaccctcaacaatcctatggtggtggataccggtaa

SEQ ID NO: 84 - protein, 895 aa, Arabidopsis thaliana
MKKVFGQTVRDLKREVNKKVLKVPGVEQKVLDATSNEPWGPHGSLLADLAQASRNYHEYQLIMVVIWKRLSDTGKNWRHVYKALTVLEYMVGHGSERVIDEIRERAYQISTLSDFQYIDSGGRDQGSNVRKKSQSLVALVNDKERIAEVRQKAAANRDKYRSSAPGGMYKPSGGYGDKYDYGSRDEERSSYGREREYGYRDDDRNSRDGDHHSRDSEDRYGRDGNRDDDYRGRSRSVDNYGSRGRSSEREREDDGHSSSRGSGARADDNSQDGRGGLQRKFSEQNIGAPPSYEEAVSDSRSPVYSERDGGETPQVTAPGAASPPPPQVAAPEAASPPTGTNTANTTATFVNESPSQKVETFDEFDPRSAFSAGPPAYASTDGVTAPPTVTSMSAPTTSNSVEMDLLGSLADVFSSNALAIVPADSIYVETNGQANAGPAPSFSTSQPSTQSFDDPFGDSPFKAFTSTDTDSTPQQNFGASFQPPPPAFTSEVSHPDTAHNFGFGDSFSAVANPDPASQNVQPPSNSPGFPQEQFATSQSGIDILAGILPPSGPPVQSGPSIPTSQFPPSGNNMYEGFHSQPPVSTAPNLPGQTPFGQAVQPYNMVPHSQNMTGAMPFNSGGFMHQPGSQTPYSTPSGPAGQFMAHQGHGMPPSHGPQRTQSGPVTLQGNNNVMGDMFSQATPNSLTSSSSHPDLTPLTGAIEIVPPPQKKFEPKSSVWADTLSRGLVNFNISGSKTNPLADIGVDFEAINRREKRLEKQTNTPATSTINMGKAMGSGTGLGRSGATAMRPPPNPMTGSGMPMGGGMGVGSYGGMNQNQPMGMGMGAGMNQNQPMGMGMGPGMNMNMNMGGYGQDYPMQPQNPGMVPSPNMPGNNYNPMMGQGGYNPQQSYGGGYR

SEQ ID NO: 85 - DNA, 2838 bp, Oryza sativa
atgaagaaagtattcgatcaaacagtccgggacctaaaaagagaggtgaacaagaaggtcctcaaggtgcctggtatagaacaaaagattcttgatgccacaagcaacgagccatggggcccacatggatcactcttggcagaaatcgcccaagcaacacaaaattaccatgagtaccagatggtcatgaatgttgtgtggaagaggatcaatgacactggtaaaaattggcggcatgtttataagggattgattgtcctggattacttggttgctcatggtacagagcgagttattgatgacataagggaacattcttatcagatatcgacactagctgatttccagtatatcgattcgagtgggagagatcaaggtagcaatgtacggcggaaatcccagagccttgttagtttagttaatgacaaagagaggatacaggaagttaggcagaaagcacttgctaccagggacaaataccggagtgcattcgccaccagtggaacacacaggagcccaggtggctatgacaatgaccgctatgaaggaagctatggcagtaggtatgataacagaaatggctacgggggagaaagagagtatggatatagggatgatgacagatatggtgttgctggaactactcccaatcgggaaggagatcgttattctagggattctaatgagcagcgctacagcagagatagagaagatgagtacaaaggaagtcatagcaaccatgaatatgcagaaggatcaggtcgcaggagctatggacgagatagggattcatatggggatgatgaagcttattcatcccgtggccggcaaagcaatgctgacggacctactcaggatgagaggcccatggagcggaagccttctaaccagcagattgcttcaccaccgccaaactatgaagatgtcacaagagatacacaggataataatcatgatggacgaaatggagggactgtgcctgtgccagttgctgcagcaaaggtgtcttcacctccaagaacaagtgtacccccaggtcaggtgaatggtgtacatgataatactgtggaagacgtacctgcaccaccacctactcatcctgaagttaatgggtttgacgagtttgatcctcgtggatcagtaccagatacctcacctccagtgaacccctcacaagccgtgaatagcttggaaatggatttattcggaccagatcctattaattcgttggctttggtatctgtgcctcagccaactgccagcccaaatgttgagccatcagcaaatccaggatttgagagtaacagttttatgggcatgccaccggcttctactggattcaatgaggcctttgatgcaactaatccttttggggatcctacgcctttcaaggctgttcatgaagaaactcctgcagtttctcagacaaatgctgcacctgctggttctttccatgctactgaacctgctgcagatgcaaatcctttccagcctgcttcagcagcaagctttggttttggagacactcttggcgacctctcttttggatcgaatgctgcacccgggcagcaagatatttttgtgcccacctcatcacattcagaggtaccacctgcaaacccatctgtgcaccctgaacaggcagtcccatcttatgtctcctcccaggcacctcagcctgcagctgctggtccacaaactcatgctgctcccgcttcatttgcttctcaagcacctcccacttcatttgcttctcaagcacctcaagcaggggcaccctatcctcaggctgcctccacatttcctcattcacaagcatctcatcctgcagccactaatccatctacaatccctcagaatgttgccacaccatttgctcctttacaaatgcctcaacctgtaccatcaggccaatcaaactattttatgcaaccagttccagggactggcattaatggcatgtctggggctccttcacagaatggagcaccatcctacatcccttcacaggcttctcaatttgcagctccaacaaatctacagccctctcagccaaccttccccccacaaactgccatggcagcttcacaggcaacatcaatttctcgaggggcatctcagcctcttgcagtgccgaattcaatgccttctggtgtgaactttccattacaatcaagttcatcagctccccctgaaacaatcctttcagccttgcaagttagtcagtctgagccagtgaagaaatttgagtccaaatctacagtttgggctgatacattgagccgaggtttagtcaatctggacatctctggaccaaaggctaatccgcacgctgatattggagttgacttcgattcaatcaatcgcaaggagaaaaggcaagaaaagaaagtctctcaagctcctgtggtatctacgatcactatgggcaaagccatgggaactggctccggcatcggtcgggcaggtgcgagtgccatggcacctccagccaacccaatgggtgcaagcaggggcattggcatgggtatgggcgctgctggttccggttacggtggtggaatgggaatgaaccggccaatgggcatgggaatgggaatgaaccaacaaatgggtatgggaatggggatgaaccaacaggccatgggaatggggatgaaccaacaggccatgggaatggggatgaaccaacaaccaatgggaatgaacatgggcatggggatgaaccagggtatgggaatgaacatgcggcctcctatgggaatgggtccaggtagtggatataatccaatgggtaccggatacggagggcagcaaccatatggtgggtacaggtga

SEQ ID NO: 86 - protein, 945 aa, Oryza sativa
MKKVFDQTVRDLKREVNKKVLKVPGIEQKILDATSNEPWGPHGSLLAEIAQATQNYHEYQMVMNVVWKRINDTGKNWRHVYKGLIVLDYLVAHGTERVIDDIREHSYQISTLADFQYIDSSGRDQGSNVRRKSQSLVSLVNDKERIQEVRQKALATRDKYRSAFATSGTHRSPGGYDNDRYEGSYGSRYDNRNGYGGEREYGYRDDDRYGVAGTTPNREGDRYSRDSNEQRYSRDREDEYKGSHSNHEYAEGSGRRSYGRDRDSYGDDEAYSSRGRQSNADGPTQDERPMERKPSNQQIASPPPNYEDVTRDTQDNNHDGRNGGTVPVPVAAAKVSSPPRTSVPPGQVNGVHDNTVEDVPAPPPTHPEVNGFDEFDPRGSVPDTSPPVNPSQAVNSLEMDLFGPDPINSLALVSVPQPTASPNVEPSANPGFESNSFMGMPPASTGFNEAFDATNPFGDPTPFKAVHEETPAVSQTNAAPAGSFHATEPAADANPFQPASAASFGFGDTLGDLSFGSNAAPGQQDIFVPTSSHSEVPPANPSVHPEQAVPSYVSSQAPQPAAAGPQTHAAPASFASQAPPTSFASQAPQAGAPYPQAASTFPHSQASHPAATNPSTIPQNVATPFAPLQMPQPVPSGQSNYFMQPVPGTGINGMSGAPSQNGAPSYIPSQASQFAAPTNLQPSQPTFPPQTAMAASQATSISRGASQPLAVPNSMPSGVNFPLQSSSSAPPETILSALQVSQSEPVKKFESKSTVWADTLSRGLVNLDISGPKANPHADIGVDFDSINRKEKRQEKKVSQAPVVSTITMGKAMGTGSGIGRAGASAMAPPANPMGASRGIGMGMGAAGSGYGGGMGMNRPMGMGMGMNQQMGMGMGMNQQAMGMGMNQQAMGMGMNQQPMGMNMGMGMNQGMGMNMRPPMGMGPGSGYNPMGTGYGGQQPYGGYR

SEQ ID NO: 87 - DNA, 3072 bp, Arabidopsis thaliana
atgaagaaagcatttggtcaaactgtcagagacctcaagagaggggtcaacaagaaagtgcttaaagtacctggaatagaacagaaggttctagatgctaccagcaatgagtcctggggtccgcatggatcacttcttgcggacattgcacatgcttcgagaaattaccatgaataccagattactatgggagtgttatggaaacgtcttagtgactctggaaaaaattggcggcatgtctataaggcattgacagtcttggagtacatggtaggccatggatcagaacgtgtcatagaagaggttaaagaacatgcatatcaaattacgacattatctggttttcagtatattgattccagcggtaaagatcaaggtagcaatgtcaggaagaaggcgcagagccttgtggctttggttaatgacaaagaaagaataacggaggtcagagagaaggctgctgctaacagagataagtatcataactcaatgcataggccgtcaggaggatatggggacaaatatgattacgaaggccgctatggagacagagatgaagggcgaagtagttatgggaaagagagagaatatggttacagggatgatgatagaaatagtcgtgatggcgatcgttattctagagactctgaagaccgatatggaagagatggtaacacggatgacgaataccgtggaaggagcagaagtgttgataattacaatggatcaagaggtaggagctcggacagggaacggcctattgaggatgatggccaatcctcatcgcgggatagtggtgcgccagctgatgatcattctcaagatgggagaggggggctagagagaaagttctctgaacaaaatattggtgctgctccacctagttatgaagaagctgtgagtgaatcacggagccctgtatacagtgaaagggatggtggagagaccccacaagttgctcctccaggagctgctgcttctcctcttgctgaaaacatcagcgtggacaacaaagctgctgattttgttaatgaatcatctcctcagcaagttgaggcttttgatgaatttgatccacgaggttcagtttcagcatgtgcacctacagctggtgcttcggttcctgcacctatcccaccaacagtggtttctacgcctgccccgcctgcctcaattaatgcagaaatggatttgcttggctctctttcagatgtattttcaccaaatcccttggctattgtaacatctgattccacttctgttgaaaccaatggacaagcaaacactggtttagctccatcgttttctacttctcagtcatctactcagccttttgatgatccatttggtgactctcctttcaaagccatcacttctgctgacactgagacaagccaacatcagagttttggagttccttttcagccaacaccaccaacttcaaatcctaacaatgaacataactttggttttggggaagcattttcagctgttaccgattctgaacctggcgttcaaaatatgcaagctccaccgaacttatccgtctttcctcaagagcagtttgatacatcgcagagcgaaatcgatattcttgccggcattctcccaccatctggaccgccagtttctctgtctccacaaccagattccactatgccaacatcccaatttcatcccaatggtaactcctatgaaagctatcatcatcaagccgcgcctacagatctaaacatgcaaggacaaacaccgtttggtcaagcttcacaacaatttaacatggtttcacattcacaaaatcatcatgaaggtatgcaattcaacaatgggggcttcacgcaacagccaggctatgcaggtccagcaacctctcaacctccacaatatactcctggtgtatcttcacacccaccaagtgagagttttcctcaccaaccaggttctgccacctcagcaagctcgcaaactccttacgctactacacccaatgtatcagctgggcagtttgatggtgggagtttcatgacacagcaaccttatggtgtgacacaacaagttcatgttgtcccttcccatataccacagcgaactcaatctggacctgttgcagcgtttgggaataataacaatatcgttggagatatgcaccaacctggttctaccccctcatcaagctcgcaaactccttaccctactacgcccaatgcaccaagtggtcagtttgatggtggaaattttatgacacaacaaccttatggtgtgataccgcaagttcatggcgtcccttcccatataccacagcgaactcaatctggacctgttgcagcgcacgggaatagtaacaatgttgttggggatatgttttcaccagctggactaagttccttggagacatcagcatcgcaaccatctctcacacctttaacaggagcaattgaaattgttccccaaaatcagaagaagtttgagccaaaatcaacaatttgggctgatacattaagtagagggctagttaacttcaacatttctggaccgaaaacaaatccattggcggatataggagttgacttcgaggcaatcaacaggaaagagaaacggctagagaaaccaactatcacacaacaacaagtaacatcaactatcaacatggggaaagccatgggatctggtactggcttaggtcgcgctggtgcaggtgctatgagacctccaacaaattcaatggtaggctcaagcatgcccacgggcatgaatgttggtggctatggaggcatgaaccaacaccaacccataggcatgaaccaaaaccatcccatgggcatgaaccaaaacctttccatgggaatgaaccagaactatcccatgggaatgaaccaaaactatccaatgggaatgggcatgaacatgaacatgggcgggtatggacaagggtatccgatgcaaccacaacaaggaatgggcatggctcctcctggtgcaccacaaggcatgaccggtgcctataatccaatgatgggtcaaggcggttacaaccctcagcagcagcaaccatatggtggaggttaccggtaa

SEQ ID NO: 88 - protein, 1023 aa, Arabidopsis thaliana
MKKAFGQTVRDLKRGVNKKVLKVPGIEQKVLDATSNESWGPHGSLLADIAHASRNYHEYQITMGVLWKRLSDSGKNWRHVYKALTVLEYMVGHGSERVIEEVKEHAYQITTLSGFQYIDSSGKDQGSNVRKKAQSLVALVNDKERITEVREKAAANRDKYHNSMHRPSGGYGDKYDYEGRYGDRDEGRSSYGKEREYGYRDDDRNSRDGDRYSRDSEDRYGRDGNTDDEYRGRSRSVDNYNGSRGRSSDRERPIEDDGQSSSRDSGAPADDHSQDGRGGLERKFSEQNIGAAPPSYEEAVSESRSPVYSERDGGETPQVAPPGAAASPLAENISVDNKAADFVNESSPQQVEAFDEFDPRGSVSACAPTAGASVPAPIPPTVVSTPAPPASINAEMDLLGSLSDVFSPNPLAIVTSDSTSVETNGQANTGLAPSFSTSQSSTQPFDDPFGDSPFKAITSADTETSQHQSFGVPFQPTPPTSNPNNEHNFGFGEAFSAVTDSEPGVQNMQAPPNLSVFPQEQFDTSQSEIDILAGILPPSGPPVSLSPQPDSTMPTSQFHPNGNSYESYHHQAAPTDLNMQGQTPFGQASQQFNMVSHSQNHHEGMQFNNGGFTQQPGYAGPATSQPPQYTPGVSSHPPSESFPHQPGSATSASSQTPYATTPNVSAGQFDGGSFMTQQPYGVTQQVHVVPSHIPQRTQSGPVAAFGNNNNIVGDMHQPGSTPSSSSQTPYPTTPNAPSGQFDGGNFMTQQPYGVIPQVHGVPSHIPQRTQSGPVAAHGNSNNVVGDMFSPAGLSSLETSASQPSLTPLTGAIEIVPQNQKKFEPKSTIWADTLSRGLVNFNISGPKTNPLADIGVDFEAINRKEKRLEKPTITQQQVTSTINMGKAMGSGTGLGRAGAGAMRPPTNSMVGSSMPTGMNVGGYGGMNQHQPIGMNQNHPMGMNQNLSMGMNQNYPMGMNQNYPMGMGMNMNMGGYGQGYPMQPQQGMGMAPPGAPQGMTGAYNPMMGQGGYNPQQQQPYGGGYR

SEQ ID NO: 89 - DNA, 2664 bp, Vitis vinifera
atgaagaaggccattggtcaaactgttagggaccttaagagagaggtgaataagaaagttcttaaagttccaggaatagaacagaaggttctggatgctactagcaatgagccttggggtcctcatggaacacatcttgcagatattgcacaggctaccagaaactatcacgagtaccaaatgatcatgtcagtaatctggaagcggattaatgatacaggaaagaattggcggcatgtctacaaggctttgacagttctggaatacttggtaggccatggttctgagcgtgtcatagatgagattcgggagcatatataccaaatatcaactttgtcagactttcaatatattgattcaagtgggagggatcagggaagcaatgtcagaaagaaatctcaaagtctcgtggctctggtgaatgataaagaaaggatacaggaagttagacagaaggctgctgccaacagggacaagtttcgcaacacaaactcagcaggcggtatgtataggcccagttcatattctagttcaggaggatatggtgaccgttatgatgatgatcgatatgaaggccgctatgggagagacgaagatcgaaatggttatgggagagaaagagaatggggcagcagagatgatgaccggtatggtagaaatggggactcatatgagattctgatgaacggtatggtagagatggctataaggatgatgattacaggggaagaagtcgaagcaatgaggactaccagtatggctctagaagtaggagtgctgatagagatagggaccgagagcaaccattcatctagaggtggtgcccgaactgatgagcatcctcagtatggaaggcagcttgaacgaaaattttctgaacaaaatcttgatgctcctcctagttatgaagaagctgtagctgatgcccacagtcctgttcatgatgagagggatggagcaaccccagcagcacctgcccctaaaacatcttctccacctgtaagcactagtcctagccaagcaacaactgctgttggtccttctacatctcctcctgccaacaaggaagttgatgcttttgatgaatttgatccgcgcggtccagtctcaggtatggagaatcctagagatttgtctgtttgccagtatgtgcagcttgagtccaaacaatttgcttgcgcttctgtcccagctacatcaattagtccggaaatggacttacttggctctctgtcagagtcattttcttcaaattcattggctcttgtgccatctggacctgcaaccacaacatctgaggctgctgtccttggaaatgctgggtctgcacccgcatcagcagcaatgccatctggatctgcttcttttgaagacccatttggtgactccccttttagagctttgccttcagcagagagtgtaccagctgaacctcaggattcagcttccacaacttccttccagaccatgaatcaaacatcaggaccacccttcccagttacccaaggagtggacacgggttccaactttgactttggggacactttccctggcataacttacacgccatccggtgtctccactgcacaacctccttctgcaagcccacaattttcaccccaagagcaatggattccccagcagaacaatgatatcctagcagacattctaccaccttcaggatcttcagctcctgccatttcacaggctgctttcccagctccaactggccagtctgtgcagccaaaccctaatgttgttgggggctttcttgcacagtcaggatctgcagatcatgcagcttcacaattttctcctcagattccaactggaccagctgcacaatataacaatgggaacttcctttcacatgggccagttacacatcctagcaatgataaccttggtggcttatttccacaagctggaccgcctggttcagtgatgtcacagtctactccccctgcttcaacaggttcacttgctatagttcctcaagcatccaaggacaagtttgaaacgaagtcaacggtttgggctgatacactgagcagaggattagtcaatttgaatatatctggagctaaaattaatccattggcggatattggaattgattttgatgccattaatcggaaagaaaagaggatggagaaacctaagcctgctaccacagctcctgtatctactactacaatgggcaaggcaatgggatctggctctggaatgggtcgtgctggtgcaggtgcactcaggcctccaccaaatactatgatgggttcaggtatgggaatgggcatgggcatgggtagtggccctggtgcaggcatgagtatgggtatgggtggtggtcctggttcaggcatgggtatgggtatgggtggtgcccctggagtgggcatgggtatgggtatgggtggtgcccctgcagcagcgggtatgggtatgggtatggggatgggaggaggcatgggcatgggaggatatggaggcatgaatcaacctatgggcatgggtatgaatgtgggcatgggcatgaatatgggaatggggcaaggagcccagatgcaacaaccaactggattgcctcctgggggttataaccccatgatgggctcaggtggttatgctcctcagcaaccatatggtggtggctaccgatga

SEQ ID NO: 90 - protein, 887 aa, Vitis vinifera
MKKAIGQTVRDLKREVNKKVLKVPGIEQKVLDATSNEPWGPHGTHLADIAQATRNYHEYQMIMSVIWKRINDTGKNWRHVYKALTVLEYLVGHGSERVIDEIREHIYQISTLSDFQYIDSSGRDQGSNVRKKSQSLVALVNDKERIQEVRQKAAANRDKFRNTNSAGGMYRPSSYSSSGGYGDRYDDDRYEGRYGRDEDRNGYGREREWGSRDDDRYGRNGDSYEILMNGMVEMAIRMMITGEEVEAMRTTSMALEVGVLIEIGTESNHSSRGGARTDEHPQYGRQLERKFSEQNLDAPPSYEEAVADAHSPVHDERDGATPAAPAPKTSSPPVSTSPSQATTAVGPSTSPPANKEVDAFDEFDPRGPVSGMENPRDLSVCQYVQLESKQFACASVPATSISPEMDLLGSLSESFSSNSLALVPSGPATTTSEAAVLGNAGSAPASAAMPSGSASFEDPFGDSPFRALPSAESVPAEPQDSASTTSFQTMNQTSGPPFPVTQGVDTGSNFDFGDTFPGITYTPSGVSTAQPPSASPQFSPQEQWIPQQNNDILADILPPSGSSAPAISQAAFPAPTGQSVQPNPNVVGGFLAQSGSADHAASQFSPQIPTGPAAQYNNGNFLSHGPVTHPSNDNLGGLFPQAGPPGSVMSQSTPPASTGSLAIVPQASKDKFETKSTVWADTLSRGLVNLNISGAKINPLADIGIDFDAINRKEKRMEKPKPATTAPVSTTTMGKAMGSGSGMGRAGAGALRPPPNTMMGSGMGMGMGMGSGPGAGMSMGMGGGPGSGMGMGMGGAPGVGMGMGMGGAPAAAGMGMGMGMGGGMGMGGYGGMNQPMGMGMNVGMGMNMGMGQGAQMQQPTGLPPGGYNPMMGSGGYAPQQPYGGGYR

SEQ ID NO: 91 - DNA, 3075 bp, Arabidopsis thaliana
atgaagaaagcatttggtcaaactgtcagagacctcaagagaggggtcaacaagaaagtgcttaaagtacctggaatagaacagaaggttctagatgctaccagcaatgagtcctggggtccgcatggatcacttcttgcggacattgcacatgcttcgagaaattaccatgaataccagattactatgggagtgttatggaaacgtcttagtgactctggaaaaaattggcggcatgtctataaggcattgacagtcttggagtacatggtaggccatggatcagaacgtgtcatagaagaggttaaagaacatgcatatcaaattacgacattatctggttttcagtatattgattccagcggtaaagatcaaggtagcaatgtcaggaagaaggcgcagagccttgtggctttggttaatgacaaagaaagaataacggaggtcagagagaaggctgctgctaacagagataagtatcataactcaatgcataggccgtcaggaggatatggggacaaatatgattacgaaggccgctatggagacagagatgaagggcgaagtagttatgggaaagagagagaatatggttacagggatgatgatagaaatagtcgtgatggcgatcgttattctagagactctgaagaccgatatggaagagatggtaacacggatgacgaataccgtggaaggagcagaagtgttgataattacaatggatcaagaggtaggagctcggacagggaacggcctattgaggatgatggccaatcctcatcgcgggatagtggtgcgccagctgatgatcattctcaagatgggagaggggggctagagagaaagttctctgaacaaaatattggtgctgctccacctagttatgaagaagctgtgagtgaatcacggagccctgtatacagtgaaagggatggtggagagaccccacaagttgctcctccaggagctgctgcttctcctcttgctgaaaacatcagcgtggacaacaaagctgctgattttgttaatgaatcatctcctcagcaagttgaggcttttgatgaatttgatccacgaggttcagtttcagcagcatgtgcacctacagctggtgcttcggttcctgcacctatcccaccaacagtggtttctacgcctgccccgcctgcctcaattaatgcagaaatggatttgcttggctctctttcagatgtattttcaccaaatcccttggctattgtaacatctgattccacttctgttgaaaccaatggacaagcaaacactggtttagctccatcgttttctacttctcagtcatctactcagccttttgatgatccatttggtgactctcctttcaaagccatcacttctgctgacactgagacaagccaacatcagagttttggagttccttttcagccaacaccaccaacttcaaatcctaacaatgaacataactttggttttggggaagcattttcagctgttaccgattctgaacctggcgttcaaaatatgcaagctccaccgaacttatccgtctttcctcaagagcagtttgatacatcgcagagcgaaatcgatattcttgccggcattctcccaccatctggaccgccagtttctctgtctccacaaccagattccactatgccaacatcccaatttcatcccaatggtaactcctatgaaagctatcatcatcaagccgcgcctacagatctaaacatgcaaggacaaacaccgtttggtcaagcttcacaacaatttaacatggtttcacattcacaaaatcatcatgaaggtatgcaattcaacaatgggggcttcacgcaacagccaggctatgcaggtccagcaacctctcaacctccacaatatactcctggtgtatcttcacacccaccaagtgagagttttcctcaccaaccaggttctgccacctcagcaagctcgcaaactccttacgctactacacccaatgtatcagctgggcagtttgatggtgggagtttcatgacacagcaaccttatggtgtgacacaacaagttcatgttgtcccttcccatataccacagcgaactcaatctggacctgttgcagcgtttgggaataataacaatatcgttggagatatgcaccaacctggttctaccccctcatcaagctcgcaaactccttaccctactacgcccaatgcaccaagtggtcagtttgatggtggaaattttatgacacaacaaccttatggtgtgataccgcaagttcatggcgtcccttcccatataccacagcgaactcaatctggacctgttgcagcgcacgggaatagtaacaatgttgttggggatatgttttcaccagctggactaagttccttggagacatcagcatcgcaaccatctctcacacctttaacaggagcaattgaaattgttccccaaaatcagaagaagtttgagccaaaatcaacaatttgggctgatacattaagtagagggctagttaacttcaacatttctggaccgaaaacaaatccattggcggatataggagttgacttcgaggcaatcaacaggaaagagaaacggctagagaaaccaactatcacacaacaacaagtaacatcaactatcaacatggggaaagccatgggatctggtactggcttaggtcgcgctggtgcaggtgctatgagacctccaacaaattcaatggtaggctcaagcatgcccacgggcatgaatgttggtggctatggaggcatgaaccaacaccaacccataggcatgaaccaaaaccatcccatgggcatgaaccaaaacctttccatgggaatgaaccagaactatcccatgggaatgaaccaaaactatccaatgggaatgggcatgaacatgaacatgggcgggtatggacaagggtatccgatgcaaccacaacaaggaatgggcatggctcctcctggtgcaccacaaggcatgaccggtgcctataatccaatgatgggtcaaggcggttacaaccctcagcagcagcaaccatatggtggaggttaccggtaa

SEQ ID NO: 92 - protein, 1024 aa, Arabidopsis thaliana
MKKAFGQTVRDLKRGVNKKVLKVPGIEQKVLDATSNESWGPHGSLLADIAHASRNYHEYQITMGVLWKRLSDSGKNWRHVYKALTVLEYMVGHGSERVIEEVKEHAYQITTLSGFQYIDSSGKDQGSNVRKKAQSLVALVNDKERITEVREKAAANRDKYHNSMHRPSGGYGDKYDYEGRYGDRDEGRSSYGKEREYGYRDDDRNSRDGDRYSRDSEDRYGRDGNTDDEYRGRSRSVDNYNGSRGRSSDRERPIEDDGQSSSRDSGAPADDHSQDGRGGLERKFSEQNIGAAPPSYEEAVSESRSPVYSERDGGETPQVAPPGAAASPLAENISVDNKAADFVNESSPQQVEAFDEFDPRGSVSAACAPTAGASVPAPIPPTVVSTPAPPASINAEMDLLGSLSDVFSPNPLAIVTSDSTSVETNGQANTGLAPSFSTSQSSTQPFDDPFGDSPFKAITSADTETSQHQSFGVPFQPTPPTSNPNNEHNFGFGEAFSAVTDSEPGVQNMQAPPNLSVFPQEQFDTSQSEIDILAGILPPSGPPVSLSPQPDSTMPTSQFHPNGNSYESYHHQAAPTDLNMQGQTPFGQASQQFNMVSHSQNHHEGMQFNNGGFTQQPGYAGPATSQPPQYTPGVSSHPPSESFPHQPGSATSASSQTPYATTPNVSAGQFDGGSFMTQQPYGVTQQVHVVPSHIPQRTQSGPVAAFGNNNNIVGDMHQPGSTPSSSSQTPYPTTPNAPSGQFDGGNFMTQQPYGVIPQVHGVPSHIPQRTQSGPVAAHGNSNNVVGDMFSPAGLSSLETSASQPSLTPLTGAIEIVPQNQKKFEPKSTIWADTLSRGLVNFNISGPKTNPLADIGVDFEAINRKEKRLEKPTITQQQVTSTINMGKAMGSGTGLGRAGAGAMRPPTNSMVGSSMPTGMNVGGYGGMNQHQPIGMNQNHPMGMNQNLSMGMNQNYPMGMNQNYPMGMGMNMNMGGYGQGYPMQPQQGMGMAPPGAPQGMTGAYNPMMGQGGYNPQQQQPYGGGYR

SEQ ID NO: 93 - DNA, 804 bp, Arabidopsis thaliana
atgaagaaagtcttcggacaaactgttagagaccttaagagagaggtcaacaagaaagtgctcaaagttcctggagtagaacagaaggttctagatgctactagtaatgagccatggggtccacatggatcacttcttgctgatcttgcgcaagcttccagaaattatcatgaatatcagctgatcatggtggtcatatggaaacgccttagcgacaccggaaaaaactggcggcatgtctataaggctttgacagttttggagtacatggtaggccatggatcagaacgtgttatagacgagattagagaacgtgcatatcaaatttcgacattgtccgattttcagtatattgattccggtggtagagatcaaggaagcaatgttaggaagaaatcacagagcctggtggctttggtgaatgacaaggaaagaatagctgaagtcagacagaaggctgctgctaatagagataagtatcgcagctcagcaccaggtgggatgtataagccttcaggcggatatggggataaatatgattacggaagccgggatgaagagcgaagtagttatggaagagaaagagaatatggttacagagatgatgatagaaatagtcgtgatggagatcgtcattccagggactctgaagaccggtatgggagagatggtaatagggatgatgattacaggggaaggagcagaagtgttgataactatgggtcacgaggtaggagttcggaaagagagcgggaggatgatggccattcttcatcacggtatgttaaatttcaagtcgcctaa

SEQ ID NO: 94 - protein, 267 aa, Arabidopsis thaliana
MKKVFGQTVRDLKREVNKKVLKVPGVEQKVLDATSNEPWGPHGSLLADLAQASRNYHEYQLIMVVIWKRLSDTGKNWRHVYKALTVLEYMVGHGSERVIDEIRERAYQISTLSDFQYIDSGGRDQGSNVRKKSQSLVALVNDKERIAEVRQKAAANRDKYRSSAPGGMYKPSGGYGDKYDYGSRDEERSSYGREREYGYRDDDRNSRDGDRHSRDSEDRYGRDGNRDDDYRGRSRSVDNYGSRGRSSEREREDDGHSSSRYVKFQVA

SEQ ID NO: 95 - DNA, 2454 bp, Vitis vinifera
atgcctggaagtgatgagcgaatggttctggatgctactagcaatgagccttggggtcctcatggaacacatcttgcagatattgcacaggctaccagaaactatcacgagtaccaaatgatcatgtcagtaatctggaagcggattaatgatacaggaaagaattggcggcatgtctacaagactttgtcagactttcaatatattgattcaagtgggagggatcagggaagcaatgtcagaaagaaatctcaaagtctcgtggctctggtgaatgataaagaaaggatacaggaagttagacagaaggctgctgccaacagggacaagtttcgcaacacaaactcagcaggcggtatgtataggcccagttcatattctagttcaggaggatatggtgaccgttatgatgatgatcgatatgaaggccgctatggaagagacgaagatcgaaatggttatgggagagaaagagaatggggcagcagagatgatgaccggtatggtagaaatggggactcatatggtcctgaaggggatcgctatggcagagattctgatgaacggtatggtagagatggttataaggatgatgattacaggggaagaagtcgaagcaatgaggactaccagtatggctctagaagtaggagtgctgatagagatagggaccgtgcttttgatgaggagagcaaccattcatctagaggtggtgcccgaactgatgagcatcctcagtatggaaggcagcttgaacgaaaattttctgaacaaaatcttgatgctcctcctagttatgaagaagctgtagctgatgcccacagtcctgttcatgatgagagggatggagcaaccccagcagcacctgcccctaaaacatcttctccacctgtaagcactagtcctagccaagcaacaactgctgttggtccttctacatctcctcctgccaacaaggaagttgatgcttttgatgaatttgatccgcgcggtccagtttcagctgtcccagctacatcaattagtccggaaatggacttacttggctctctgtcagagtcattttcttcaaattcattggctcttgtgccatctggacctgcaaccacaacatctgaggccgctgtccttggaaatgctgggtctgcacccgcatctgcagcaaagccatctggatctgctgttatgagccagtcttttgaagacccatttggtgactccccttttagagctttgccttcagcagagagtgtaccagctcaacctcaggattcagcttccacaacttccttccagaccatgaatcaaacatcaggaccacccttcccagttacccaaggagtggacacgggttccaactttgactttggggacactttccctggcataacttacacgccatccggtgtctctactgcacaacctccttctgcaagcccacaattttcaccccaagagcaatggtttccccagcagaacaatgatatcctagcagatattctaccaccttcaggatcttcagctcctgccatttcacaggctgctttcccagctccaactggccagtctgtgcagccaaaccctaatgttgttgggggctttcttgcacagtcaggatctgcagatcatgcagcttcacaattttctcctcagattccaactggaccagctgcacaatataacaatgggaacttcctttcacagttgggttctgcagcgcctgtaccttcacaggctcctcttcaargtcctgtaccttctcagtctccttttcaaagtcctgtaccttctcagtctccttttcaagctcctgtaccttctcagtctccttttcaagctccagctaaaatagtgtcttcatatgcagctaaaattaatccattggcggatattggaattgattttgatgccattaatcggaaagaaaagaggatggagaaacctaagcctgctaccacagctcctgtatctactactacaatgggcaaggcaatgggatctggttctggaatgggtcgtgctggtgcaggtgcactcaggcctccaccaaatactatgatgggttcaggtatgggaatgggcatgggcatgggcatgggtagtggccctggtgcaggcatgagtatgggtatgggtggtggtcctggttcaggcatgggtatgggtatgggtggtgcccctggagtgggcatgggtatgggtatgggtggtgcccctgcagcagcgggtatgggtatgggtatgggtatggggatgggaggaggcatgggcatgggaggatatggaggcatgaatcaacctatgggcatgggtatgaatgtgggcatgaatatgggaatggggcaaggagcccagatgcaacaaccaactggattgcctcctgggggttataaccccatgatgggctcaggtggttatgctcctcagcaaccatatggtggtggctaccgatga

SEQ ID NO: 96 - protein, 817 aa, Vitis vinifera
  UNSURE (583)..(583): Xaa can be any naturally occurring amino acid
MPGSDERMVLDATSNEPWGPHGTHLADIAQATRNYHEYQMIMSVIWKRINDTGKNWRHVYKTLSDFQYIDSSGRDQGSNVRKKSQSLVALVNDKERIQEVRQKAAANRDKFRNTNSAGGMYRPSSYSSSGGYGDRYDDDRYEGRYGRDEDRNGYGREREWGSRDDDRYGRNGDSYGPEGDRYGRDSDERYGRDGYKDDDYRGRSRSNEDYQYGSRSRSADRDRDRAFDEESNHSSRGGARTDEHPQYGRQLERKFSEQNLDAPPSYEEAVADAHSPVHDERDGATPAAPAPKTSSPPVSTSPSQATTAVGPSTSPPANKEVDAFDEFDPRGPVSAVPATSISPEMDLLGSLSESFSSNSLALVPSGPATTTSEAAVLGNAGSAPASAAKPSGSAVMSQSFEDPFGDSPFRALPSAESVPAQPQDSASTTSFQTMNQTSGPPFPVTQGVDTGSNFDFGDTFPGITYTPSGVSTAQPPSASPQFSPQEQWFPQQNNDILADILPPSGSSAPAISQAAFPAPTGQSVQPNPNVVGGFLAQSGSADHAASQFSPQIPTGPAAQYNNGNFLSQLGSAAPVPSQAPLQXPVPSQSPFQSPVPSQSPFQAPVPSQSPFQAPAKIVSSYAAKINPLADIGIDFDAINRKEKRMEKPKPATTAPVSTTTMGKAMGSGSGMGRAGAGALRPPPNTMMGSGMGMGMGMGMGSGPGAGMSMGMGGGPGSGMGMGMGGAPGVGMGMGMGGAPAAAGMGMGMGMGMGGGMGMGGYGGMNQPMGMGMNVGMNMGMGQGAQMQQPTGLPPGGYNPMMGSGGYAPQQPYGGGYR

SEQ ID NO: 97 - DNA, 1632 bp, Chlamydomonas reinhardtii
atgtggcacactgtggccttcacgaagctcaaagtgctggaggcgaccaacgaggagccatggggaccccacgggtccgcgatgggggagattgcgcgtgcagcggaggacccagagaaatacaacctcatcatgaacgtcatcagcgagcgcctgcagatgcgggacgagaactggcgcctgtgctacaaggcgctgctgctgctcgagtaccttgttaaaaacgggccttggcgtgtggtagacgagctcaaccgcagcgtgtcctcgctggagcgactgcgtgatgagtttgagtaccgtgacccgcagggcaaggaccacggtgtcaacgtgcggcagagggcgggtgagctggcctcactcgtcagcaacaccgaccgcgttcgccaggagcgtgaaaaggctgccaaaaacgccaacaagtataagggcgtatcgtcgtcggacatgcgcggatttggtggcggtaacctgacatggcttcctgcgcgcccccagcaggcctaccccggcacggagagcgtgcacatgcctgccggcagcagcagcagccaccacagccgcaccggatcgggctccaacgccaacacctttaacgccttcaacaaccccacagccgccggccactcgggcggcggctttggtgggctgcgcggcactggaccggcggctgggtctggggtggggcccgaggagggcgaggacccattcgaggccacccgcaagcggatagagcggctgaaggcggagggcgcgctgccggagccgccgccgtcagcgctgccgccgggtctggcagacgtgccggccgcaggcgccaaggctcccaagaagctgtccgaaatcaaaatcaaccccgcggtggccgccacgttcgcgtccatgcccatcgcgccgccgcccagcggtgcaaccataggcaagctggcaccgcctccgggcgccggtggtgctgccaagccgccgctgccgctgcccgccgcgagcaacaccctggacctgtttggggagctgagcggccccacatcctcgcagcccgctcagtcacagcccgcggccagcgctgcttcggactgggacgctttcggctcggcgccagctgttgcgccggcgcccgctgcggctccggccgcgccggtggatccctttgccgtgctcgcctctggacccaccgcggccacagcaacatctggtggcagcgcctcgttgggcggctttaagcccgcggtagcgacgcacgcgagtacctcttccaagccgggcgtgccgccgccgctgtcattcgacgacttcgctgagctgcccgccgcgccgcctgcagcgggggcagaccccttcgcggcactggcaagcggcggctccgcggcggcttcgcgcccagcggtaccagcgccagcacctgcggcggccttcgacccgtttgcgccggcgccgtcgaccatggcgacagcgcctgcgacgagcagtgggtttggcgactttatgagcggcaaccggtcctcatcgcacgccagctccggcggcgcggctagctcgggcggcgcgaccatggcaatgaacaaggcgggcgcggcgcacggggctgcggggcaaaagagcaacgacccgtttgcagggctagggttctag

SEQ ID NO: 98 - protein, 543 aa, Chlamydomonas reinhardtii
MWHTVAFTKLKVLEATNEEPWGPHGSAMGEIARAAEDPEKYNLIMNVISERLQMRDENWRLCYKALLLLEYLVKNGPWRVVDELNRSVSSLERLRDEFEYRDPQGKDHGVNVRQRAGELASLVSNTDRVRQEREKAAKNANKYKGVSSSDMRGFGGGNLTWLPARPQQAYPGTESVHMPAGSSSSHHSRTGSGSNANTFNAFNNPTAAGHSGGGFGGLRGTGPAAGSGVGPEEGEDPFEATRKRIERLKAEGALPEPPPSALPPGLADVPAAGAKAPKKLSEIKINPAVAATFASMPIAPPPSGATIGKLAPPPGAGGAAKPPLPLPAASNTLDLFGELSGPTSSQPAQSQPAASAASDWDAFGSAPAVAPAPAAAPAAPVDPFAVLASGPTAATATSGGSASLGGFKPAVATHASTSSKPGVPPPLSFDDFAELPAAPPAAGADPFAALASGGSAAASRPAVPAPAPAAAFDPFAPAPSTMATAPATSSGFGDFMSGNRSSSHASSGGAASSGGATMAMNKAGAAHGAAGQKSNDPFAGLGF

SEQ ID NO: 99 - DNA, 594 bp, Ostreococcus lucimarinus
atgttcaaagccgcgctgacgacgatcaagtccgcgatcccggacgaggtggcgcaggcggcgaagaagcgcgtcaatcaatggaaaggcatcggcgacgacgaagcgctcgtccgcgacgcgacgaactccgagccctggggcccgcacggggagcagctgcgcgcgatcgcgcggctcacgcgcgatgggaagtgggacgtcgtgcgcgaggtgctggagaaacgcttgaagagcgcgccggaggagtggcgacgcgcgtacaaggcgctcaccgtcgtcgagtatctcgtcgcgaacggcgatcgagcgatcgcggaggacgtcaggcgaaggcgaatgatggacggcgcgctgaggttcgagtacaaggacgcgcgagggaaggatgagggggtgaacgtgcgacatcgagcggaaaagatcaaggcgttggtggaagatccgagatcggtcgaggaggcgagggaaaaggcggagagaaatcgcggcaagtacgcggggatgtcgagcgaagaagcgcggacgcacgcgcggagagggtcgacgtcgagcgcgggtgggtcgttttcgggagggagcgcgctcggcggc

SEQ ID NO: 100 - protein, 198 aa, Ostreococcus lucimarinus
MFKAALTTIKSAIPDEVAQAAKKRVNQWKGIGDDEALVRDATNSEPWGPHGEQLRAIARLTRDGKWDVVREVLEKRLKSAPEEWRRAYKALTVVEYLVANGDRAIAEDVRRRRMMDGALRFEYKDARGKDEGVNVRHRAEKIKALVEDPRSVEEAREKAERNRGKYAGMSSEEARTHARRGSTSSAGGSFSGGSALGG

SEQ ID NO: 101 - DNA, 2435 bp, Oryza sativa
ggtcgttattccgcggcgccatcttcctctctcctccgccctacgcgtcgccccgcctcgcctggccttccccgcgcatcctgcacggagccctaggaggctaggagaggaagaagaacacgcgcgcggggggatagtggatagccgaagcaactcgatcgatctgtggccgcgatcgtagctctcttcttggtccgatctcgtctctcccggcatggatttcaggaaggtgctcgaccagaccgtccgggagataaggagggaggtaaatcttaaggtgctcaaggtgccggaaatcgagcagaaggttcttgatgccaccagcgacgagccgtgggggccgcatggttccgatttggcagatatcgccagggccaccaagagctacggtgatagcgaaattataatgaatgtgttatggcaacgcctggggaacacacttgcgaattggcgtcacgtgtataaggcgttggctgtgatcgagtaccttctagctaatggcaccgaacgtgcagctgatggcattgttgacaatagctcacgaattgcaaaactcacaagatttgagtatttggagcctaatggaaaagatgttgggctcaatgtgcgtaagaaggctgaagctgttctagcaattttggatgacagggagaagcttcaagaggtcagagagaaggctgccgttactagagacaagtattttggcttatcatcaactggaataacgcacaaatcgagcgcagcatcatttggcagtggcagctactcatctggtagccactatgggagcacaggaggttcaagggaggtgggatcattcaaggatatacacacaggcacagaatggaaaaagaacaagaaggaaacagtgtcaaactacagcagcaatagagaagggtctaaagaaattactaacagtgcaaccagttataagtcaaaaaagagtgaaaggcatggtagaagaaatcaaaattccttaacattacactcgaagttatctgcaaatattagcaccacatctgaagccccaagctcaaagaaaggggaaaatgaggatgatgatgatttcaacccacgaggattttctacatctactggaacaggtaccacaagatctaatcacctggatctctttggtccaagcttgatggatgatcttgttgattctactacatccacttcaacagcaacgccaaatgttagcacacctgctgtgccagaggttgatttatttgcagatgcagctttccaatcagccaatgctccattggaggcagcaacggtttctcacactcaggacaaaattgatttgtttgctggcagactgtcttctgctgattcatttacttcagacacagagttctcagtacgcggtagtcctaacaagtcatcggagaaaaaaatgtcttccgttgtgcatccttctacttctgcttttgatcccttcaaacaatcttttgccacctcatttccttcagattcagagttctcagttcatgatccgacaagcaaatcttctcaaggaaaaactcccacaccagaacattcaagtacagcagcttttgatccttttgctgcaattccactgaagagttttgatggatccgaatcttttggaacattttcttcgaacacagcctcaaacattactgaactgccacgggattcttctgggggtcccaaaagttctgaccatggtcctttggaggatgccaattttgatgccttcacttcacacttgggatcttccacaacaagtgcaactgagtccatgaataagcccatcaaaaagcttgggcaggactcgatgtcagcatcaaaatcagttgcaaagaaagaaacttttcaggtcaaatctggcatatgggctgactctttgagccgaggattgattgatttgaatataacttcgtcacaaaagaaggtcgatctctccgatgttgggattgtcggaccgctgagcggcggatctgaggataaaggcccgggggcgacgatgggcacagcaccaggccttgtcagttctagttttccatctaaaacagaaacatccagtggaagcggtcattttcagcaccaacagtttggaagctttaagtgatttttatccaggatatgtcttttgttctatggttcttgcagagtacttcttggagcattcgtacagctccatgcctataagagtaaacgtgtatatagctaccaaactctgtgcgatgatcaggagacgtgttgccaactaaccagcatcttctctgcccttgaggcattaatatttttttacttatggcgaaatggatatgttttgtgtacatgagtaaagaaccaatgccatggtagcaattgtaaaaagggttcatcaattatgtgtgatacacgctcatatgaattttgaaaaatgaataacgcaaagcattctggatgctggcagtgcc

SEQ ID NO: 102 - protein, 628 aa, Oryza sativa; identical to SEQ ID NO: 72

SEQ ID NO: 103 - protein, 602 aa, Oryza sativa
MDFRKVLDQTVREIRREVNLKVLKVPEIEQKVLDATSDEPWGPHGSDLADIARATKSYGDSEIIMNVLWQRLGNTLANWRHVYKALAVIEYLLANGTERAADGIVDNSSRIAKLTRFEYLEPNGKDVGLNVRKKAEAVLAILDDREKLQEVREKAAVTRDKYFGLSSTGITHKSSAASFGSGSYSSGSHYGSTGGSREVGSFKDIHTGTEWKKNKKETVSNYSSNREGSKEITNSATSYKSKKSERHGRSTTSEAPSSKKGENEDDDDFNPRGFSTSTTPNVSTPAVPEVDLFADAAFQSANAPLEAATVSHTQDKIDLFAGRLSSADSFTSDTEFSVRGSPNKSSEKKMSSVVHPSTSAFDPFKQSFATSFPSDSEFSVHDPTSKSSQGKTPTPEHSSTAAFDPFAAIPLKSFDGSESFGTFSSNTASNITELPRDSSGGPKSSDHGPLEDANFDAFTSHLGSSTTSATESMNKPIKKLGQDSMSASKSVAKKETFQVKSGIWADSLSRGLIDLNITSSQKKVDLSDVGIVGPLSGGSEDKGPGATMGTAPGLVSSSFPSKTETSSGSEYFLEHSYSSMPIRVNVYIATKLCAMIRRRVAN

SEQ ID NO: 104 - protein, 618 aa, Oryza sativa
MDFRKVLDQTVREIRREVNLKVLKVPEIEQKVLDATSDEPWGPHGSDLADIARATKSYGDSEIIMNVLWQRLGNTLANWRHVYKALAVIEYLLANGTERAADGIVENSSRIAKLTRFEYLEPNGKDVGLNVRKKAEAVLAILDDREKLQEVREKAAVTRDKYFGLSSTGITHKSSAASFGSGSYSSGSHYGSTGGSREVGSFKDIHTGTEWKKNKKETVSNYSSNREGSKEITNSATSYKSKKSERHGRSLMDDLVDSTTSTSTATPNVSTPAVPEVDLFADAAFQSANAPLEAATVSHTQDKIDLFAGRLSSADSFTSDTEFSVRGSPNKSSEKKMSSVVHPSTSAFDPFKQSFATSFPSDAEFSVHDPTSKSSQGKTPTPEHSSTAAFDPFAAIPLKSFDGSESFGTFSSNTASNITELQRDSSGGPKSSDHGPLEDANFDAFTSHLGSSTTSATESMNKPIKKLGQDSMSASKSVAKKETFQVKSGIWADSLSRGLIDLNITSSQKKVDLSDVGIVGPLSGGSEDKGPWYMGATMGTAPGLVSSSFPSKTETSSGSAHFQHHSLEALSDFYPGYVFCSMVLAEYFLEHSYSSMPIRVNVYIATKLSAMIRRRVAN

SEQ ID NO: 105 - DNA, 2388 bp, Oryza sativa
gggccatcgcccaccggcccacgagcaccatctctcctctctgctccgcgagtggccttttgcccacctaagccgcctccccatcctctgcttgctccggcgggcggcgagcgccccgccggaccgacgacgacctcgccgtcgagctggtggccgctcaacctctagcgctcgcagggatcccgggaagcctccctcggccgcgtcaccaccggcatctggtgctttccgctcccaccacagtgtgctgctctcgtcagttgccaccgcccgactcggcgctccggagcccagatcttggttccggaggatcctctccggcgatggatttcgtgaaggttttcgatcaggccgtgcgggagataaagagggaggtcaatttgaaggtgctcaaggttccagagctcgaacagaaggtacttgatgcaacaagcgatgaaccttggggccctcatggtactactctttcagagctatcacatgccaccaagaagttcgctgaatgtcagatggtaatgagtgtcctctggactaggctgtctgagcgaggctcgaaatggcgtcacgtgtataaggctttgacaattattgagtacttaatagccaatggttctgagcgggcagttgatgacattcttgatcactattcaaagatctcggttctttcaagttttgaatatgtggaacctaatggaaaagatgctggaataaatgtgagaaagaaagtcgaaactatattgggactcataaatgacaaggagaaaataaagtctgtaagagagaaagccgccagtaatcgtgacaagtatgttgggctatcatcgacagggataacatataagtcaagctctgcttcatttggtagcaactatagttctggtgaacgttatgggagttttagtggtacaagggaaggtgattcatacggtgacagttatagggataaagaacctgttaaatcctctccaagttatactggcagccagaaatctggcagcaggataaaaaaggatgtgaatagaaggaatgaggattcaccgagctccttgaagtctaatgcaaaaggcaatgaggacgattttgatgattttgatcctcgtggatcttcttcaaatggtgcagctaatacaaacaccagtggcgtggatctttttgccccaaacttattggatgatttcatcgatgtgcctgcagcagcaactcatgaaacaaacgactctgcagacgctcaggttgatctgtttgctgatgcagatttccaatcagcaataccaagtacagaaacagctgcgggttcagatgtccagggcaatgtagacctttttgcggaacagccagccttcacagcagcctttccaccacagacagggtttattccaccaccaagttctgggacatctgaagcaaatacttccacgtctaagaacacaactcctgaaccttttgatccttttggtgctattcctataaacagctttgatggatctgatccatttggtgccttcaactccgatgttggatcatctagtataccaccacccacgcagagttctgttggaaatatcagcacaccaagtcagaaccctcaagcagcatctgactttggtggctttgtgtcgagcactgtagaaacagcagctaaggacccctttgatttttcaagtagcaatcttgggaaaacacctttggcagatccaaaggctgatgcatccgattttggtgcctttgtatcgcacagtgaggaagtagccaaggatccttttgatctttctttgagtaccagctctggaaggacaaaccaagcacctctggcggctcccaagtcagataccaagaaagaaaattttcaggtcaagtctggcatatgggctgactcattgagccgtggactgattgatctgaacataactggaccaaagaaggtgaacttagccgacgttgggattgtcggtggcctcgatgacgggtctgatgataaagctctgccctcatggaccatgggtgcaggaggttccagcctaggaatgtccggaattccttcatctacacaaagtggtggcattgagagcttagctaactacaacaagtaccagtttggctttaaatgagctttcatgtgaggctttctagtatatgccggttattgtcggaatgtcggcttgtgccttatttattttttgttgattctattctcccctcttttgatgcttacattcctttacaatcgcctccaaggatcgtgatcttggttcgtcttgtcgcgcttgtattgtatttattggatttgcggatgagagactcctacctatatcacaccctgattcaatttaactgtactgttatttcacaatcgtgttaatcctatggctcacctctatattgcgattt

SEQ ID NO: 106 - protein, 594 aa, Oryza sativa; identical to SEQ ID NO: 70

SEQ ID NO: 107 - protein, 593 aa, Oryza sativa
MDFVKVFDQAVREIKREVNLKVLKVPELEQKVLDATSDEPWGPHGTTLSELSHATKKFTGALYYEFYIGHYANTNGQSEQQTLALTIIEYLIANGSERAVDDILDHYSKISVLSSFEYVEPNGKDAGINVRKKVETILGLINDKEKIKSVREKAASNRDKYVGLSSTGITYKSSSASFGSNYSSGERYGSFSGTREGDSYGDSYRDKEPVKSSPSYTGSQKSGSRIKKDVNRRNEDSPSSLKSNAKGNEDDFDDFDPRGSSSNGAANTNTSGVDLFAPNLLDDFIDVPAAATHETNDSADAQVDLFADADFQSAIPSTETAAGSDVQGNVDLFAEQPAFTAAFPPQTGFIPPPSSGTSEANTSTSKNTTPEPFDPFGAIPINSFDGSDPFGAFNSDVGSSSIPPPTQSSVGNISTPSQNPQAASDFGGFVSSTVETAAKDPFDFSSSNLGKTPLADPKADASDFGAFVSHSEEVAKDPFDLSLSTSSGRTNQAPLAAPKSDTKKENFQVKSGIWADSLSRGLIDLNITGPKKVNLADVGIVGGLDDGSDDKALPSWTMGAGGSSLGMSGIPSSTQSGGIESLANYNKYQFGFK

SEQ ID NO: 108 - DNA, 3750 bp, Oryza sativa
gtcagggaagaagggaggacgcgacgcgacacgagcgcgagaggaaagcggaggagatcgaggagaaactccatttccccccccctcgccttctccgatttccctcgcgtggaatccccttggactcctccccctcccgccgccgcgcgagccgggcacggcgagcggcgccgccctgcccccgccgatctgctctgccttctcctcaggggcttgcaccgaggaggaggaggaggagagagctgagcagaacaagctagattctcaaggaagggcgccatgaagaaagtattcgatcaaacagtccgggacctaaaaagagaggtgaacaagaaggtcctcaaggtgcctggtatagaacaaaagattcttgatgccacaagcaacgagccatggggcccacatggatcactcttggcagaaatcgcccaagcaacacaaaattaccatgagtaccagatggtcatgaatgttgtgtggaagaggatcaatgacactggtaaaaattggcggcatgtttataagggattgattgtcctggattacttggttgctcatggtacagagcgagttattgatgacataagggaacattcttatcagatatcgacactagctgatttccagtatatcgattcgagtgggagagatcaaggtagcaatgtacggcggaaatcccagagccttgttagtttagttaatgacaaagagaggatacaggaagttaggcagaaagcacttgctaccagggacaaataccggagtgcattcgccaccagtggaacacacaggagcccaggtggctatgacaatgaccgctatgaaggaagctatggcagtaggtatgataacagaaatggctacgggggagaaagagagtatggatatagggatgatgacagatatggtgttgctggaactactcccaatcgggaaggagatcgttattctagggattctaatgagcagcgctacagcagagatagagaagatgagtacaaaggaagtcatagcaaccatgaatatgcagaaggatcaggtcgcaggagctatggacgagatagggattcatatggggatgatgaagcttattcatcccgtggccggcaaagcaatgctgacggacctactcaggatgagaggcccatggagcggaagccttctaaccagcagattgcttcaccaccgccaaactatgaagatgtcacaagagatacacaggataataatcatgatggacgaaatggagggactgtgcctgtgccagttgctgcagcaaaggtgtcttcacctccaagaacaagtgtacccccaggtcaggtgaatggtgtacatgataatactgtggaagacgtacctgcaccaccacctactcatcctgaagttaatgggtttgacgagtttgatcctcgtggatcagtaccagatacctcacctccagtgaacccctcacaagccgtgaatagcttggaaatggatttattcggaccagatcctattaattcgttggctttggtatctgtgcctcagccaactgccagcccaaatgttgagccatcagcaaatccaggatttgagagtaacagttttatgggcatgccaccggcttctactggattcaatgaggcctttgatgcaactaatccttttggggatcctacgcctttcaaggctgttcatgaagaaactcctgcagtttctcagacaaatgctgcacctgctggttctttccatgctactgaacctgctgcagatgcaaatcctttccagcctgcttcagcagcaagctttggttttggagacactcttggcgacctctcttttggatcgaatgctgcacccgggcagcaagatatttttgtgcccacctcatcacattcagaggtaccacctgcaaacccatctgtgcaccctgaacaggcagtcccatcttatgtctcctcccaggcacctcagcctgcagctgctggtccacaaactcatgctgctcccgcttcatttgcttctcaagcacctcccacttcatttgcttctcaagcacctcaagcaggggcaccctatcctcaggctgcctccacatttcctcattcacaagcatctcatcctgcagccactaatccatctacaatccctcagaatgttgccacaccatttgctcctttacaaatgcctcaacctgtaccatcaggccaatcaaactattttatgcaaccagttccagggactggcattaatggcatgtctggggctccttcacagaatggagcaccatcctacatcccttcacaggcttctcaatttgcagctccaacaaatctacagccctctcagccaaccttccccccacaaactgccatggcagcttcacaggcaacatcaatttctcgaggggcatctcagcctcttgcagtgccgaattcaatgccttctggtgtgaactttccattacaatcaagttcatcagctccccctgaaacaatcctttcagccttgcaagttagtcagtctgagccagtgaagaaatttgagtccaaatctacagtttgggctgatacattgagccgaggtttagtcaatctggacatctctggaccaaaggctaatccgcacgctgatattggagttgacttcgattcaatcaatcgcaaggagaaaaggcaagaaaagaaagtctctcaagctcctgtggtatctacgatcactatgggcaaagccatgggaactggctccggcatcggtcgggcaggtgcgagtgccatggcacctccagccaacccaatgggtgcaagcaggggcattggcatgggtatgggcgctgctggttccggttacggtggtggaatgggaatgaaccggccaatgggcatgggaatgggaatgaaccaacaaatgggtatgggaatggggatgaaccaacaggccatgggaatggggatgaaccaacaggccatgggaatggggatgaaccaacaaccaatgggaatgaacatgggcatggggatgaaccagggtatgggaatgaacatgcggcctcctatgggaatgggtccaggtagtggatataatccaatgggtaccggatacggagggcagcaaccatatggtgggtacaggtgagattatactgtacaatgcgatactcagtgaggggttgagaaacagtttaggaggcgtttggattttggtcacctggattttctttatgtatggtttcttttgttttgggtggggggggggggttataatttttcatcactattcttttcctatccatgttggatattgtatctactaaatatatgacatgtgaacgggggcaatgctacaactactgtgttgtgttggatgcaaagccttaatactataatcatcaatgtagctgtataattctctataggatgtttttttttcagtaaacattgtgattgtttcagcgttcttgctggcttgacaataaaaaggctgtaccattttgttcaagctatcttcctttctttttatgtcgtcacattttgaggtgcagacctgcagtttttgtgtcagatgtcacccgtcagtctgcaaatagtagtatatttttgctcgtccgaactttggaactacaggaatggcccatctctgctgtcgcctcttttctgttctgatgcgtggtcacacaagccactgttgacacagcaactttgtatctccattattgacacagcaactttgtatctgatcataatgaaacgaagaattttgtgagttcaa

SEQ ID NO: 109 - protein, 945 aa, Oryza sativa; identical to SEQ ID NO: 86

SEQ ID NO: 110 - protein, 945 aa, Oryza sativa
MKKVFDQTVRDLKREVNKKVLKVPGIEQKILDATSNEPWGPHGSLLAEIAQATQNYHEYQMVMNVVWKRINDTGKNWRHVYKGLIVLDYLVAHGTERVIDDIREHSYQISTLADFQYIDSSGRDQGSNVRRKSQSLVSLVNDKERIQEVRQKALATRDKYRSAFATSGTHRSPGGYDNDRYEGSYGSRYDNRNGYGGEREYGYRDDDRYGVAGTTPNREGDRYSRDSNEQRYSRDREDEYKGSHSNHEYAEGSGRRSYGRDRDSYGDDEAYSSRGRQSNADGPTQDERPMERKPSNQQIASPPPNYEDVTRDTQDNNHDGRNGGTVPVPVAAAKVSSPPRTSVPPGQVNGVHDNTVEDVPAPPPTHPEVNGFDEFDPRGSVPDTSPPVNPSQAVNSLEMDLFGPDPINSLALVSVPQPTASPNVEPSANPGFESNSFMGMPPASTGFNEAFDATNPFGDPTPFKAVHEETPAVSQTNAAPAGSFHATEPAADANPFQPASAASFGFGDTLGDLSFGSNAAPGQQDIFVPTSSHSEVPPANPSVHPEQAVPSYVSSQAPQPAAAGPQTHAAPASFASQAPPTSFASQAPQAGAPYPQAASTFPHSQASHPAATNPSTIPQNVATPFAPLQMPQPVPSGQSNYFMQPVPGTGINGMSGAPSQNGAPSYIPSQASQFAAPTNLQPSQPTFPPQTAMAASQATSISRGASQPLAVPNSMPSGVNFPLQSSSSAPPETILSALQVSQSEPVKKFESKSTVWADTLSRGLVNLDISGPKANPHADIGVDFDSINRKEKRQEKKVSQAPVVSTITMGKAMGTGSGIGRAGASAMAPPANPMGASRGIGMGMGAAGSGYGGGMGMNRPMGMGMGMNQQMGMGMGMNQQAMGMGINQQAMGMGMNQQPMGMNMGMGMNQGMGMNMRPPMGMGPGSGYNPMGTGYGGQQPYGGYR

SEQ ID NO: 111 - DNA, 1356 bp, Brassica napus
ttcccgggtcgacgatatgagattattgagcatacttaccaaatctctgtcagtatttcttttcttatatatttataagtcattttcctgtggtggaaccttgtgacatgatctttgtttgtgagttgttacagtcactcacgagttttgagtatgttgaaccgaatgggaaagatgtggggatcaatgtgagaaagaaggcggaaaacatagttgctctcttgaataacaaggagaagatctctcaaatcagagacaaagcaacagccaatcgtaacaagtacgttggcctctcctcaacaggaataacatataagtctggttcagcttcagcttcgtttggtggtggtagtggttcaagcaattatgacagctatagagatagggattccagagaagacaaggacgactacgagtcttttcaaaagtcaaggcgcggtgttaaaggtgaagaccaaagctacacttcgaagaaaagtttttcacgctatggcagtgcggaccaggatagtctatccagtggaaaaaagtctcccggctctggcaaacacagtgccataccttcacatgcatctgcagctccttcaaacaacgatgatgattttgatgattttgatccacgtggaacttccagcaagaagccttccgcggggagtgccaaccaagtggacctttttggagcagatctgattggtgacttcttggattctgggccaactgaaacatcttccaccaacaacaatgggaagtttcaagaggcggacttgtttgctgatgcagattttgtatcagcctccagtccaagaacagactttgggtcacaggcacagtttcttcagctcctgcgacggttgatctttttgcatctccggaaacagttgcacgcccagaagccaagattcctaaacctgagccgatcaccactccaagcattgttgacccatttgctgcagttcctatggaaaattttgatggatctgatccttttggtgccttcacttctcactcggcttcagtctctacaggtccacaggccccagttctacatgggagtgcaacaaacacaacaaccccaccctctttggcagactcgaaaccacaacagtttcaaaagaaggatcctttccaggtgaaatctggaatatgggcagattcgctgagccgtggactaattgatctcaatattactgctcccaaaaaggcttctcttgctgatgtgggtgttgtcggtggcctgagcaatgacgatgggaacaaggcatctgctgctgcctactactcagggtggtccatgggcgcaggatccgggctcggtaaaaccggaatatacaatgcccagcagcagcagcaacaaca

SEQ ID NO: 112 - protein, 341 aa, Brassica napus
MIFVCELLQSLTSFEYVEPNGKDVGINVRKKAENIVALLNNKEKISQIRDKATANRNKYVGLSSTGITYKSGSASASFGGGSGSSNYDSYRDRDSREDKDDYESFQKSRRGVKGEDQSYTSKKSFSRYGSADQDSLSSGKKSPGSGKHSAIPSHASAAPSNNDDDFDDFDPRGTSSKKPSAGSANQVDLFGADLIGDFLDSGPTETSSTNNNGKFQEADLFADADFVSASSPRTDFGSQAQFLQLLRRLIFLHLRKQLHAQKPRFLNLSRSPLQALLTHLLQFLWKILMDLILLVPSLLTRLQSLQVHRPQFYMGVQQTQQPHPLWQTRNHNSFKRRILSR

SEQ ID NO: 113 - DNA, 2051 bp, Glycine max
tataatcacaatattaggagaaatatatatgaacaaaccatcccaaaaagcttaacaagcttggtaatgccgacacacaaagaatgggtgaaaatgtgatgggaagagtataaaatctgagaattttacttttggaacccgccaaattgatgttgttggtttccaaggtttgagaaaaagtcgtctccagctgctggctgtgaaggagtgaatccagacctacccattccaagaccagatcctgaacccatagctctccccatgtaaaatgaaggtggagggcctttctccctttcatcggatccatcactcaatccacccacaattccaacatccacaagggatacttttttaggagcagttatattgagatcaatcagtccacggcttagtgaatcagcccagacgccagacttcacctgaaaagcatcctttttaggggaaactttagagtctgctaaagatttaccagtcacattatcatgcttgccatcactgacaacattattggagggctgtgaagacacagaatcagattgagaagtaaaatcaccaaaaatatcagatccatcaaaattattaagaggaacagcagcaaagggatcgatagagctgttattcataggaacagacttctccgacttgttgtttggctgcactgccagttcaggaatggaaaacaagtcaactgtaggtgtaactgtaggaatggctggttgtgaagaaaatagatcaacctcagcctgtggttgagaaatggctcctttatccagatgaggttctgctgatacaaatgatgcatctgcaaaaagatcaacctctggtacattactagttgctggcttttctacaggaacagatgttggagcatccatgaggtcaccgattaaatcttgtccaaagagatcaacctggttagagtttccagctgaagttttggtagaagttcctcttggatcaaaatcatccatgtcatcctcagtactgtttgcaggtacacttgaactttgagaaggaactgaaccataattatttgcattagtagatgactttgatactctagatgacttgttctcctgacttttgctggcagagcgagcagaacccttcttgaaggagttctcttgattgtcactagcggtggcatggtgtgattttccttggtaatctttttcttcttcataggatcctttgtctctatagctatcattaaacctgtcaccatctctagatccaaagcctccatatttaccactgctttgaaagctgctgccactaccataagaggaggctgacccagacttgtatgtgattccactagaagaaactccaatgtacttgtcacggtttgcagcagctttatttctgacttcatgtatcttatctttatcattcaaaagtgacacaatgttttcagccttcttccttacattgagtcccacatccttcccactaggttcaacatattcaaaactagaaagtgcagagatctgaaaagtatgttctataatgtcatcaactgcacgttcagatccatgtgctaccaaatattctatgacagctaatgccttgtatacatagcgccaatcttttccagtttcacccagtcttgtccaaaggacattcatgactatttgacattcagtaaattttttggtagcctgtgaaatctctgccagcacagtaccatgaggaccccaaggttcattatcagtagcatccagcaccttctgttcgatttccggaatcttgagcaccttcagattcacctctctctttatttctcgaacggtttgatcgaagaccttcatgaaatccatggcggtggatctgatctgatccgatctgaagaggagaaaggttggaaaggggttatgcttatgttaattgcagggaattcgatggctgtagttttcagtagaaatgatttgagatctaatacattcggatcgaatttttgttttccttccaaaaattttcctcaaccctgcttctttttactcttcggaattaaatatgtttttcattcacgagaataccagtaaatttgc

SEQ ID NO: 114 - protein, 564 aa, Glycine max
MDFMKVFDQTVREIKREVNLKVLKIPEIEQKVLDATDNEPWGPHGTVLAEISQATKKFTECQIVMNVLWTRLGETGKDWRYVYKALAVIEYLVAHGSERAVDDIIEHTFQISALSSFEYVEPSGKDVGLNVRKKAENIVSLLNDKDKIHEVRNKAAANRDKYIGVSSSGITYKSGSASSYGSGSSFQSSGKYGGFGSRDGDRFNDSYRDKGSYEEEKDYQGKSHHATASDNQENSFKKGSARSASKSQENKSSRVSKSSTNANNYGSVPSQSSSVPANSTEDDMDDFDPRGTSTKTSAGNSNQVDLFGQDLIGDLMDAPTSVPVEKPATSNVPEVDLFADASFVSAEPHLDKGAISQPQAEVDLFSSQPAIPTVTPTVDLFSIPELAVQPNNKSEKSVPMNNSSIDPFAAVPLNNFDGSDIFGDFTSQSDSVSSQPSNNVVSDGKHDNVTGKSLADSKVSPKKDAFQVKSGVWADSLSRGLIDLNITAPKKVSLVDVGIVGGLSDGSDEREKGPPPSFYMGRAMGSGSGLGMGRSGFTPSQPAAGDDFFSNLGNQQHQFGGFQK

SEQ ID NO: 115 - DNA, 2338 bp, Hordeum vulgare
gaattcggccgaggctctgctcccctccctccccgcacgcgcgcgccctccgcccggcaggccgacgacctcgccgtcgaggtggccgccgtccgtcgcgagggctcgccgctcgccgggatcgggggagccgccgccgccaccgccgcgcctccatcccgtccagacgcagcctcctaggccactcgctcgtctgccactaccagctcagcgcccgacagcccagatccccccaccgtatagagtccccggccagccttcgacgccgcgccggccatggatttcatgaaggccttcgatcagaccgtaagggagatcaagagggaggtcaatctcaaggtgctcaaggtccccgagctcgaacagaaggtacttgacgcgacaagtgatgaaccttggggtccccatggctctgctctttcagagctagctcaggccaccaagaagtactctgagtgtcagatggtgatgggtgtcctctgggccaggttgggtgagcgaggtgcaaactggcgtcatgtgtataaggcactgacgattattgagtacttgatagcgaatggttctgagcgggcagttgatgacattctcgatcattattcaaagatctcggttctttcgagttttgagtttgtggaacctaatggaaaagactctggaataaatgtgaggaagaaagtggaaactctggtgggaatcatcaatgataaggagagaataaaggctgtgagagagaaagctgccagtaaccgtgacaagtacgttgggttatcatcaacagggtcaacatatagatcaagctcagcctctgtaggtagcaactacagttcaggtgaacgttatggcagttttggtggaacaagggaggctgattcgttcagtaacagttacagggacaaagaacctgttaaaacctcttcaagtaatactggcaggcgcaaatctggcagcaagataagaaaggatgcggatcatgatagaagctcatcgaagtccccatctaacacaaaaggcaatgaggatgaattcgatgactttgatcctcgtggatcttcttcaaatggtgcagctaatacaaagactgccgaggtggatcttcttggcccaaacttgatggatgatttccttgacgagcctgcagccaccccagcagaaaaaagtgctttagaacctcaggttgatctgtttgctgatgcagatttccaatcggcaaacccaggtgccgaaacagctgcgcatcaggatgtccaggaaactgttgaccttttttcgggaaatgcaacctttgcttcagcctttccaccacagactgggtttatcccaccaccaacttctgggacaccttctaatgctaatacttccgtgtccaagaacacagtacccgaaccatttgatcctttcggtgatattcctttaagcagtttcgggggatctgacccatttggtgactttagctcctctagtgcaccaccaccacctgtacacagctccactggaaatatcagcacgtcaagtcagaaccttgaggcagcatcggactttggtgcctttgaatcaaacaccgcggatacagctaaagaccccttcgacttttcttccactggcaattttggcaaagcagatgtagcacctttggcagctcccaaaactgatgcgtctgattttggtgccttcgttacaaacactgaagaagcagctaaagaccccttcaatctttcttcaagtattaatggaagggcagaccaaacacctttggcagctcccaagtccaacaccaagaaagaaaattttcaggtcaaatctggcatatgggctgactctttgagccgtggattgattgatctgaacataactggaccaaagaaggtgaacttagcagatgttggggtcgtcggcggccttagtgatgggttcgacgataaggcacagccctcatggaacatgggtatgggtgcaggggtatctggcctaggaatgtctggagttcctccttctacgcaaggcggtggcatcgagagcttggcaaactacaacaagtatcagtttggtggcttcaagtgagctcatatgagaacatttttagcacctggtgtttgttactttttgctggactgcgcctttgaatgcttattgtcttattcgttttgccacctcgcttttgttgatccggcacattccttataattgccgctgtattcaattatcgtggtatttgtccagtgttatcatgcctgtgttgtgtttgttgggtttgcagacaacccttgtgtcacaccatgattcgattcagtcttatggttaatatgtgcaccttctgtaaacggcatgccttttgctt

SEQ ID NO: 116 - protein, 594 aa, Hordeum vulgare
MDFMKAFDQTVREIKREVNLKVLKVPELEQKVLDATSDEPWGPHGSALSELAQATKKYSECQMVMGVLWARLGERGANWRHVYKALTIIEYLIANGSERAVDDILDHYSKISVLSSFEFVEPNGKDSGINVRKKVETLVGIINDKERIKAVREKAASNRDKYVGLSSTGSTYRSSSASVGSNYSSGERYGSFGGTREADSFSNSYRDKEPVKTSSSNTGRRKSGSKIRKDADHDRSSSKSPSNTKGNEDEFDDFDPRGSSSNGAANTKTAEVDLLGPNLMDDFLDEPAATPAEKSALEPQVDLFADADFQSANPGAETAAHQDVQETVDLFSGNATFASAFPPQTGFIPPPTSGTPSNANTSVSKNTVPEPFDPFGDIPLSSFGGSDPFGDFSSSSAPPPPVHSSTGNISTSSQNLEAASDFGAFESNTADTAKDPFDFSSTGNFGKADVAPLAAPKTDASDFGAFVTNTEEAAKDPFNLSSSINGRADQTPLAAPKSNTKKENFQVKSGIWADSLSRGLIDLNITGPKKVNLADVGVVGGLSDGFDDKAQPSWNMGMGAGVSGLGMSGVPPSTQGGGIESLANYNKYQFGGFK

SEQ ID NO: 117 - DNA, 701 bp, Medicago truncatula
aggctgaaatcttagatatcacagcaacagaacccatcgaatttcgcctcaattaacacaaagctacataacctttcccttcagatcagatctacacagatcaatcatcatggatttcatgaaagtcttcgatcaaaccgttcgagaaattaagagagaggtgaatctgaaggtgcttaaggttcctgaaatcgaacagaaggtgttggatgcaactgacgatgagccttggggtcctcatggtactgtgctggcagagattgcaactgctaccaaaaaatttactgaatgtcagctggttatgaatgttctttggacaagattggctgaaactggaaaggattggcgatatgtatacaaggcattagctgttatagagtatttggtatcacatggatctgaacgtgcagttgacgacattatagaacatacttttcagatctctgcactttctagctttgaatatgttgagcctaatgggaaggatgtgggactcaatgtaaggaagaaggcagaaaacattgttgcccttttgaatgatagagaaaagatacatgatattagaaataaagctgctgcaaaccgtgacaagtacgttggagtttcatctagtggaatgacatacaaatccgggaacacctcatttagtagtgggagcagtaacaaatatgggaggttttggttcaagtggtgataggttt

SEQ ID NO: 118 - protein, 194 aa, Medicago truncatula
MDFMKVFDQTVREIKREVNLKVLKVPEIEQKVLDATDDEPWGPHGTVLAEIATATKKFTECQLVMNVLWTRLAETGKDWRYVYKALAVIEYLVSHGSERAVDDIIEHTFQISALSSFEYVEPNGKDVGLNVRKKAENIVALLNDREKIHDIRNKAAANRDKYVGVSSSGMTYKSGNTSFSSGSSNKYGRFWFKW

SEQ ID NO: 119 - DNA, 2032 bp, Medicago truncatula
  misc_feature (18)..(18): n is a, c, g, or t
  misc_feature (29)..(29): n is a, c, g, or t
accacgcgggggccgcgntcttgaactantgcagcaacagaacccatcgaatttcgcctcaattaacacaaagctacataacctttcccttcagatcagatctacacagatcaatcatcatggatttcatgaaagtcttcgatcaaaccgttcgagaaattaagagagaggtgaatctgaaggtgcttaaggttcctgaaatcgaacagaaggtgttggatgcaactgacgatgagccttggggtcctcatggtactgtgctggcagagattgcaactgctaccaaaaaatttactgaatgtcagctggttatgaatgttctttggacaagattggctgaaactggaaaggattggcgatatgtatacaaggcattagctgttatagagtatttggtatcacatggatctgaacgtgcagttgacgacattatagaacatacttttcagatctctgcactttctagctttgaatatgttgagcctaatgggaaggatgtgggactcaatgtaaggaagaaggcagaaaacattgttgcccttttgaatgatagagaaaagatacatgatattagaaataaagctgctgcaaaccgtgacaagtacgttggagtttcatctagtggaatgacatacaaatccgggacaacctcatttagtagtgggagcagtaacaaatatggaggttttggttcaagtggtgataggtttagtgatagctacggagacaaggggcgctatgatgaagcaaaaatagacaaagattactcaggaaaatcacggcatggtgtctcaagtaaaaatgaagagaactccttcaaaaaaggttctgttcggtctgtcagcaaaagtcaggagaacaaatcttctagagcatcaaagtcatctgctaatgcagttccttctcaaagtgcaagtgtacctactgaggacgactttgatgattttgatccgagaggaacatctagtaagacttcagctggaagctcaaaccaggttgatctctttggacaagatttgctcggtgacttcatggatgctccaacatctgtttctgtagaaaagccagcaactagtaatgtgtcagatgttgatctctttgcggatgcatcatttgtttcagcagcaccacatgcggacaaaggagctagttctcaaccacaggatgaagtggatcttttctcttcacaaccagccattccttcagttacaccaacagttgacttgttttccattccttcaccagctgtgcagcctgacagcaagtcggaaaactctgttcctgtgaataacagcacttttgatccctttgcttctgttccacttaataattttgagggatctgatgtttttggtgattttacttctcaatctgattctgtatcttctcagccctcaacgaatgctgccaccgatggtagtacaagtggtaaatctgtaacagactctaatgtttcgcctaaaaaggatgcttttcaggtgaagtctggcatttgggctgattcactaagccgtggattgattgacctcaatatatctgctcccaaaaaaagtatcccttgtcgatgttggaattgtgggtggattaagtgatggattagatgaaagggagaaaggccctccaactacattatacatggggagagctatgggtacaggatccggtcttggtatgtatggtggcactccttcacagtcaacagctggagatgacatattttcaaacttcggtggccaaaactatcaatttggtgggttccagaagtaaaaaaattcacaaattgtatactcattccatcacattttcactcattctttgtgtgtcggctttatcaagattgctgagctttttggcatggtggattttgttaatatatatttctctctattttgtatccaagaaaggtaggaatagcaatttcctatcactattgtgattatattatcttaaattcatgctactgttgcattttaaatgtttgattacaagatccagcaaactgaagtacccaaatagcttgtgatactgcttt

SEQ ID NO: 120 - protein, 490 aa, Medicago truncatula
MDFMKVFDQTVREIKREVNLKVLKVPEIEQKVLDATDDEPWGPHGTVLAEIATATKKFTECQLVMNVLWTRLAETGKDWRYVYKALAVIEYLVSHGSERAVDDIIEHTFQISALSSFEYVEPNGKDVGLNVRKKAENIVALLNDREKIHDIRNKAAANRDKYVGVSSSGMTYKSGTTSFSSGSSNKYGGFGSSGDRFSDSYGDKGRYDEAKIDKDYSGKSRHGVSSKNEENSFKKGSVRSVSKSQENKSSRASKSSANAVPSQSASVPTEDDFDDFDPRGTSSKTSAGSSNQVDLFGQDLLGDFMDAPTSVSVEKPATSNVSDVDLFADASFVSAAPHADKGASSQPQDEVDLFSSQPAIPSVTPTVDLFSIPSPAVQPDSKSENSVPVNNSTFDPFASVPLNNFEGSDVFGDFTSQSDSVSSQPSTNAATDGSTSGKSVTDSNVSPKKDAFQVKSGIWADSLSRGLIDLNISAPKKSIPCRCWNCGWIK

SEQ ID NO: 121 - DNA, 983 bp, Physcomitrella patents
aggcagtagtagtagtagtggtagtagtaccggagtggagagggtttgcgacgcggagcgccatagccgagctcggctgagcagctatggatctgaagaaggtgttcgatcagactgtccgcgagctgaagcgggaggtcaacaagaaggtgcttaaggttcccgagattgaagtgaagatactggaggcgaccagtaacgagccatggggtccgcacggaacgataatgggtgacattgcacaggctactcggaaccacaacgactaccaaatgataatgaccgtcctttacaaacgcttgaatgacactgggaggaattggcgccatgtctacaaggctttgacggttttggagtatttggttgcaaacggctctgagagggtcattgatgaacttcaagagcatacttatcagattcagacgttgtgtgaatttcagtacttagagcaaagtggcaaggatcagggaatcaatgtacggaagaaggcacaaactttggttgccttaatcaaggataaagataagattcgtgaagtgagaagcaaggcagcagccaaccgagacaaatatcgtggcgtctccagcactggaatgacacatcgttctagttcctattcaagcaccggaggaggttatggtgatagggacgatgaccggtatggaggaagccgtggaggaagagatgaatatgattacagtgggagaggcggcggccgagatgctgatcggtacagggatgatgatccttacggaggaggtagagagcgaagcaggaatagtagttacgatggtcgtgatgcatctaaggaacgtgatgcttatggatcgaagggaaatgacagttatccgtcaaaaggaggtgatcgagatggttatgcctcaaagggaggtgatcgttatgagaagtacgagagtggatctgtaagtgaccgcgaccgtgatagagggtacgatgacgacgacagttattcttccaggtga

SEQ ID NO: 122 - protein, 298 aa, Physcomitrella patents
MDLKKVFDQTVRELKREVNKKVLKVPEIEVKILEATSNEPWGPHGTIMGDIAQATRNHNDYQMIMTVLYKRLNDTGRNWRHVYKALTVLEYLVANGSERVIDELQEHTYQIQTLCEFQYLEQSGKDQGINVRKKAQTLVALIKDKDKIREVRSKAAANRDKYRGVSSTGMTHRSSSYSSTGGGYGDRDDDRYGGSRGGRDEYDYSGRGGGRDADRYRDDDPYGGGRERSRNSSYDGRDASKERDAYGSKGNDSYPSKGGDRDGYASKGGDRYEKYESGSVSDRDRDRGYDDDDSYSSR

SEQ ID NO: 123 - DNA, 690 bp, Physcomitrella patents
atggatctaaagaaagtgttggaccaaacggtccgagaatttaagagggaagtgaacaagaaagtcctcaaggtgcctgaaattgagctcaaagtttgcgaggccacgagcaatgagccctggggaccgcatggagcaatcatgggtgatatcgcacaagcgactcggaacttccaagactatcacatgattatgggggttttgtggaagcgcttgcacgactctgggaagaattggcgacacgtctataagtcactagcagtgatggagtacctcattgccaatggagctgagcgagtaattgatgaactgcgggagcaggcttaccaaatccaggttttactggatttccaacacattgagcccaacggcaaagatcagggtatcaatgtgaggaaaaaggcagagagcctgttggcgctgatcaatgaccctggcaagattcgtgaactacagcaaaaggctgctgctaacagagataagtatcgaggcctctctaatacggggatgagcttcaagccaagttcgtatttaagcacaagcggtagctacagcgacaaagaaaacgagcggtatgggggaggctcgagcgtgaatgcacaaaaggatgatgaagtccacaaggaagatcagcgagaatccaacaggtcagagtactggcaaaaagtgacgcttgcaggctgtaattaa

SEQ ID NO: 124 - protein, 229 aa, Physcomitrella patents
MDLKKVLDQTVREFKREVNKKVLKVPEIELKVCEATSNEPWGPHGAIMGDIAQATRNFQDYHMIMGVLWKRLHDSGKNWRHVYKSLAVMEYLIANGAERVIDELREQAYQIQVLLDFQHIEPNGKDQGINVRKKAESLLALINDPGKIRELQQKAAANRDKYRGLSNTGMSFKPSSYLSTSGSYSDKENERYGGGSSVNAQKDDEVHKEDQRESNRSEYWQKVTLAGCN

SEQ ID NO: 125 - DNA, 3285 bp, Physcomitrella patents
atgccacgttctgagctgggggtgaaggcaaaacgaggtcaagacccaggaattcctgcagcatgggtcgtgccaggaatagaagcggcgaggagcgctgttgcggtgcaagctggccatgaagaatcgctccgccctctagaaccatcacaactttgcagcttgcgacgggatcgactgggagcggtaatgactgattcatcgacctcattattgtcgcaacgcatccgtcgcggttttggcagcccatccgcacgccggacggaaggaagcttgggctgcgtcttcggggatggaagtcggtctcgacgcgctttgaatccggtggaattttggggttgtgcgggaagaagagcttcgtctgtagctgagctcgggtgcgcagctatggatctgaagaaagtgtttgatcagaccgtccgggagctgaagcgagaggtcaacaagaaggtgcttaaggttcccgagattgaagtgaaggtggtcgttctacatgtggatgtgaataagcgtcgcaatgctacgttggcagagctagcatgcaccttttactgcactaattaccttcttttctacaagactaaaaacgagacattcaaggattctgcaaggcagagagagatagtgggctgtacatctgttcttttcgaggtccatgtagaggggatttatatggtgttggaggcaaccagcaacgagccttggggtcctcatggatcgatcatgggagacattgcgcaggcttctcgaaattacaatgactaccaaatgataatggctgtcctgtacaaacgcctaaatgacactgggagaaattggcgccatgtgtacaaggctttgacagttttggaattcttgattgcaaatggcgcagagagggtcatcgatgaacttcaagagcatacttatcagatccagacattgtgcgattttcaatacctagagccaagtggcaaggatcagggaattaatgtacggaagaaggctcagactctggtagctttgatcaaagataaagatagaatccgagaagtgagaagcaaggcggctgccaatcgtgataaatatcgtggagtctctagcaccggaataactcaccgctcaagttcttattcaagcactaggggaagttatggtcatagggatgatgagcggtatggaggaagccgtgggggaagagacgaatatgattacactgggaggggcagtggccgagatggtgatcggtatagggacgaggatccttacggaagagatagggagcgaagtagagatagtagttacgatgggcgcgatgcatctaaagagcgtgatgcttatgggtccagggcaggtgatagttattcgtcgaaaggtggtgatcgcgatggttacggctcaaaggcaggtgatcgttatgataagtacgagagcggatctgcaagtgatcgcgaccgtgaaaggggttacgatgacgacgatagctactcttctaggaatggcaagtcgaaaggcggatctacaccacctcctgcttacgaggaagcggttcagaggcttgcttccgacgtagatagtaacgagggccaaggtgtggctgcagcggtggcaaaagctttcagcagtcaggaagaggctactgtgctcaccgcatcagagatcgtgccaaaaccaagtgcaaattgctcttttgatgcaagccaaacggcagacgatgattttgatgattttgaccctcgcggaaccagccactcagcttctgcctctacagcaagtcagccaacggagaatttctttccagaatcaggaaatctatctttattccccgattcaacttctgcaccccctgcacctcctgcacaagcacaacttcctccagcagcgcaaaaaagtttaggtggccttgaagacctattcggtggtagttttgatgtagctcctgtttcaacttctgttaccactcccgccccagcgcctcccaatttcttctcgaacaacgcggtgcaagcaaatgatttgtttggagattcattttctgtgactccttctagtgcatctgatgggttcggagcttcagcttttcaatccactccagcttctgctgcccctgcagtagcttcggacccgtttggtggatcgtcgttccaactgggccctccacccccaccccctcctgtttatcaaccgccagctgcccctgctagcaacttcggaaataactccttccagagtcatggtgcaccaggagtgcccaatggtttgaatgcaaatatgttcgggcacccatcgactccatttgacccggctactaacaacaatggattttctcatatatccgggcaaagctttggcaacaaccagagtttccctcgaaatcaatcgttcagcggcatgacccaagcatccagtgtaaatcaatcctattatggagcctcacagaatatgggtggcataaatagatccgcttcagcgccacaagaattacagcacttggaacaaccaccaaaaccacagcaaccagctagaaaggaattcggaccagtgaagtctgccatttggggagacacacttagcatgggccttgttgatctcaacatcgcaggaccgaaagtaaatcctctaaacgacctcggaattcagttgacagaccctactctaaagaacgagctttggggtgccgacaacccgaagcaagcccaaaaaaagcctgcatcgtcatctgggatggggatgggacagcctatgggtaaagctatgggatccggcactggccttggtagagcaggggccagtggactacctcctcctatgcctgcgaccacaatggcaagaccaggtatgggcatgggtcctcaacaggctggtgccatgaacttcaacatgggcatgggcatgggcatgggttctaatataggcatttcgccgggcatgagtatgggtcctcagatgggaacgggtatgaaccagatgggatcaatgttacatatgggtatgggaggctacccaaaccaacagcaacagtatggctatagtaaaacgctttggcaaaatttaacccctgattccatagtccattgcggtggacatgtatttgtctttacaggaccagttacgctttcatgcgtccgtgcctacatgccgacattcttggtcagatccagctcttgtgttgtggtggtctttgttactatcactttctttccttaccactctcactggtggctttttgaattccctttcgtcagctcagtaaattctgattatatcccaggcacaattcctggtcattctctttattggttctga

SEQ ID NO: 126 - protein, 1094 aa, Physcomitrella patents
MPRSELGVKAKRGQDPGIPAAWVVPGIEAARSAVAVQAGHEESLRPLEPSQLCSLRRDRLGAVMTDSSTSLLSQRIRRGFGSPSARRTEGSLGCVFGDGSRSRRALNPVEFWGCAGRRASSVAELGCAAMDLKKVFDQTVRELKREVNKKVLKVPEIEVKVVVLHVDVNKRRNATLAELACTFYCTNYLLFYKTKNETFKDSARQREIVGCTSVLFEVHVEGIYMVLEATSNEPWGPHGSIMGDIAQASRNYNDYQMIMAVLYKRLNDTGRNWRHVYKALTVLEFLIANGAERVIDELQEHTYQIQTLCDFQYLEPSGKDQGINVRKKAQTLVALIKDKDRIREVRSKAAANRDKYRGVSSTGITHRSSSYSSTRGSYGHRDDERYGGSRGGRDEYDYTGRGSGRDGDRYRDEDPYGRDRERSRDSSYDGRDASKERDAYGSRAGDSYSSKGGDRDGYGSKAGDRYDKYESGSASDRDRERGYDDDDSYSSRNGKSKGGSTPPPAYEEAVQRLASDVDSNEGQGVAAAVAKAFSSQEEATVLTASEIVPKPSANCSFDASQTADDDFDDFDPRGTSHSASASTASQPTENFFPESGNLSLFPDSTSAPPAPPAQAQLPPAAQKSLGGLEDLFGGSFDVAPVSTSVTTPAPAPPNFFSNNAVQANDLFGDSFSVTPSSASDGFGASAFQSTPASAAPAVASDPFGGSSFQLGPPPPPPPVYQPPAAPASNFGNNSFQSHGAPGVPNGLNANMFGHPSTPFDPATNNNGFSHISGQSFGNNQSFPRNQSFSGMTQASSVNQSYYGASQNMGGINRSASAPQELQHLEQPPKPQQPARKEFGPVKSAIWGDTLSMGLVDLNIAGPKVNPLNDLGIQLTDPTLKNELWGADNPKQAQKKPASSSGMGMGQPMGKAMGSGTGLGRAGASGLPPPMPATTMARPGMGMGPQQAGAMNFNMGMGMGMGSNIGISPGMSMGPQMGTGMNQMGSMLHMGMGGYPNQQQQYGYSKTLWQNLTPDSIVHCGGHVFVFTGPVTLSCVRAYMPTFLVRSSSCVVVVFVTITFFPYHSHWWLFEFPFVSSVNSDYIPGTIPGHSLYWF

SEQ ID NO: 127 - DNA, 2792 bp, Populus trichocarpa
cagtactgcccttcaactcgtcctccgacaatgaagaaggcctttgatcaaactgtcagggacatcaagagagaggttaataagaaagtgctcaaagttccttcgatagaacagaaggttcttgatgctaccagtaatgagccttggggtccgcatggaacacttcttgcagatattgcacaggcatctagaaattatcatgaatatcagatgatcatggcagttttatggaaacggcttaatgataccggcaggaattggcggcatgtctacaaggcgttgactgttttggaatatctggttgctcatggatcagagcgtgtcatagatgagataagggaacattcatatcaaatatcgacattgtcaaatttccaatatattgactccagtggaaaggaccagggtaataatgtcaggaagaaatcccagagtcttgtggccctggtgaatgataaagaaaggataattgaagttagacagaaggctgctgctaacagggacaagtttcgcacatctcctggtggaatgtatagacctggctcttattcaagtacaggggggtatgatgacgatggtcgctataaggatgaggatcgaaatggatatggttatggcaaagaaagagaatacaattatagggatgatgaccggtatggtaaatacggggattcgtatggtcgtgatgctgatcgttacggtgaagaacggtatggcagagatggatatagggatgatgactatcagggaagaagtcgaagcattgatggttatgggtcaagaagcaggagctccgacagagatagagatcgggcttttgatgacgatggtcaatcctcatctcgcggcagtggtgctagagctgatgatcgggctcaggatggaaggcggcttgagcgaaaaccttccgagcaaaatattggtggtcctcccagctatgaagaaactataagtgaatcccgaagccctgctcacagtgaaaggaatggggaaactttagcagcacctgctcctggagcttctccacctccaagcaatcctggacaagcaaacacttttgatgtgaggtctccatctcctgcagaccgggaaattgaggtggctgatgaatttgatccacgtggtcctgtttcagcttcccccacagcaacatctgttccaactgcctctgctttccctaccacctcaaacaatgctgaaatggatttactcggctctttatcagatgtttttgctccaaatccattggccattgtgccagtcacttctgcaacatcatcctctgaagctgatgcccaggcaaacttttctggatccacttttgcttcaacacaatcagcctctaatattatgaaccaggctttcgaagatccatttggtgataatccttttaaagctactcctacagacaatttctcagcccaacagccaactgcttcggctgcccctttccagcctactatgaatcaaaatgctgaaatgccccatgcagctgcaccaccaaatggtgatgcattctctgacatgacttattcagcacccaatgttcaacctccttcaacaaactcacacttttttcctcaagaaatgtcaagttctcatccagaaactgatattctggcagacattctctcatcatccggtccttatgctgcagcctcacaggcaggtttttcatttccttctggccaacctccacagttaggggctagcatgtacgggaacttcaatccaccagcagggaatatggtaccgccagcagttccacacatggctcctcagacccaacaattaagcagtgcaaacttccttccacagggaggattcccagctactaacccttccaacatggctctacaacctccagctggaccagtggcacattttaacaatggaaactttccacaacaaggttctgcagccccagttgtccctcaattttctcaccatacactgactggatcaaccccacaatttaacagtggaaactttcacccacaacgtggctctacagtcccagtttcttcacaatttacttaccaaactccaaccgcttcatctcctcaacagaaagatgtcctgggtaatttgttttctcaaggatcgaactcttccatgtcatctcagacagctcttccatcttcaacagggtcgcttgctatagttcctctaccatccaaagacaaatttgagaccaagtcaacagtgtgggcagatactatgagtagagggctggtcaatttgaatatttctggacctaaaaccaatccattggctgacattggagttgattttgatgcccttaatcgcaaggaaaagagaatggaaaaacagcccatgactccagttacatctactgtcaccatgggcaaagctatggggtctggtactgggatgggccgacctggtgcaggtgttctcagcccacctccaaaccctatgattggttctggtatgggaatgggtgtgggtgcgggcgtgaatatgggcattggtatgggtggtcgtcctggttcaggcattggcatgggaggttatggaggagtgcaccagcccatgggtgtgggtgtgggtgtgggaatggggatgatgaacatgggaatgatgccaggtggccagatgcctcctggatcagccatgcctggtggctataaccccatgatgggttctggtggttacactccccaacaacattatggcggatatcgatgagatggatcaaccatactgaagggcaacgaatacctgttgatttttggaggtaaaaggggatggcattgctaaccccaagt

SEQ ID NO: 128 - protein, 893 aa, Populus trichocarpa
MKKAFDQTVRDIKREVNKKVLKVPSIEQKVLDATSNEPWGPHGTLLADIAQASRNYHEYQMIMAVLWKRLNDTGRNWRHVYKALTVLEYLVAHGSERVIDEIREHSYQISTLSNFQYIDSSGKDQGNNVRKKSQSLVALVNDKERIIEVRQKAAANRDKFRTSPGGMYRPGSYSSTGGYDDDGRYKDEDRNGYGYGKEREYNYRDDDRYGKYGDSYGRDADRYGEERYGRDGYRDDDYQGRSRSIDGYGSRSRSSDRDRDRAFDDDGQSSSRGSGARADDRAQDGRRLERKPSEQNIGGPPSYEETISESRSPAHSERNGETLAAPAPGASPPPSNPGQANTFDVRSPSPADREIEVADEFDPRGPVSASPTATSVPTASAFPTTSNNAEMDLLGSLSDVFAPNPLAIVPVTSATSSSEADAQANFSGSTFASTQSASNIMNQAFEDPFGDNPFKATPTDNFSAQQPTASAAPFQPTMNQNAEMPHAAAPPNGDAFSDMTYSAPNVQPPSTNSHFFPQEMSSSHPETDILADILSSSGPYAAASQAGFSFPSGQPPQLGASMYGNFNPPAGNMVPPAVPHMAPQTQQLSSANFLPQGGFPATNPSNMALQPPAGPVAHFNNGNFPQQGSAAPVVPQFSHHTLTGSTPQFNSGNFHPQRGSTVPVSSQFTYQTPTASSPQQKDVLGNLFSQGSNSSMSSQTALPSSTGSLAIVPLPSKDKFETKSTVWADTMSRGLVNLNISGPKTNPLADIGVDFDALNRKEKRMEKQPMTPVTSTVTMGKAMGSGTGMGRPGAGVLSPPPNPMIGSGMGMGVGAGVNMGIGMGGRPGSGIGMGGYGGVHQPMGVGVGVGMGMMNMGMMPGGQMPPGSAMPGGYNPMMGSGGYTPQQHYGGYR

SEQ ID NO: 129 - DNA, 2846 bp, Populus trichocarpa
cattgccgttcttcaactattctgctgataatgaagaaggtctttggtcaaactgtcagggacttcaagagagaggttaataagaaagttctcaaagttccttcgatagagcagaaggttcttgatgctaccagcaatgaaccttggggtccacatggatcactgcttgcagatattgcgcaggcatcaagaaattatcatgaataccagatgatcatggcagttctctggaaacgaattaatgatactgggaagaattggcggcatgtctacaaggctttgactgttttggaatacctggttgctcatggatcagagcgtgccatagatgagattagggaacattcttatcaaataacgacattgtcagatttccaatatattgattccagcggaaaggaccagggtaacaatgtcaggaagaaatcccagagccttgtggtcctggtgaatgataaagaaaggatagttgaggctagacagaaggctgctgctaacagggacaagtttcgcaacgcatcacctggtggaatgaatagacctggttcttatgatgatgacggtcgctatggaaacagggatgaagatcgaaatggatatggttatggcaaagaaagagaatacaattatagggatgatgaacggtatggtaaatatggggactcgtatggtcgtgatggagatcataatggtgaagaacggtatggtagggatggatatagggatgatgactatcagggaagaagccgaagcattgatgattacggttcaagaagcaggagctctgatagagatagagatcatgcttttgatgatgatggtcaatcctcatctcgtggcgctagagctgatgatcagtctcatgacggaagcattgctaagcggcttgagcgaaaattttctgagcaaaatattagtggtccacccagctatgaagaagccttaagtgaatcccgaagccctgctcacagtgaaaggaatggagaagctttagcagtacctgctcctgtagcttcttctccaccagctcctagatctttctctccacctgcttttaatgctgcttctccacctccaagcaatcctggacaagaaaacactttttttgcgacgcctgcatctcctgcagaccaggaagttgtggtggctgatgaatttgatccacgtggtcctatttcagctccccctactgccacatctgttcaaactgcctctgctttcactccgacttcgaacaatgctgaaatggacttacttggctctttatcagatgtgtttactccaaatccattagccatcatgccagttacttctgcaacaactacctctgaagctgattctcaaacaaacttttcaggatccatgtttgctgcaacacaatcaccatcaaatgttatgaatcaggcttttgaagatccatttggtgactctcctttcaaagctactcctacagatgctttctcagctcaacagcccactgcttcttctgcccctttccagcctaccatgaatcaaaatacagaaatgcccaatgcagtagcaccaccaaatggtgacacattctctgccatgacttattcagcacccaatgttcaacctccttcaacaaatccacactttttgcctcaagaaatgtcaagttctcatccagaaactgatattctggcagacatcctcccaccatctggtccatctgctgtagcttcacaggcaggtttttcacttccatctggccaacatccacagccaggtgctagtgtgtatgggaacttcaattcaccaccagggaatatggtattgctggcagctccacacatggctcctcagggccagcaattaagcagtgcaaacttctttacacagggaggatccccagctcctatccattccaacatgtctctacaacctccggctgggccagtggtgctgtttaataatggaaacttagttccacaacaaggttctacggctccagttgtctcacaattttctcatcatacaccgactggatcagcaccacaatataacagtggaaactttctcccacaacatggctctactttcccagtcgcgtcacaatttacttaccaaactccacctgcttcatctcctcaacataatgatgtcctgggtaatttgttttcacaagggccaaacacttccatggcttctcagacagctcttccatcttcaacagggtcgcttgctatagttcctcaaccatccaaggacaaatttgagactaagtcaacagtgtgggcagatactctgagtagagggctggtcaatttgaatatttctggacctaaaaccaatccattagctgacattggagtcgattttgatgcccttaatcgcaaggaaaagagaatggaaaaacagcccatgactccagttgtatctactatcaccatgggcagagctatgggatctggtactgggttaggccgagctggtgcaggtgttctcaggccacctccaaaccctacgattggttctggcatgggaatgggtgggggtgtgaatatgggcatgggcatgggtatgggtggtcctggttcaggcattggcatgggaggttatggaggaatgcaacaacccatgggtggtgtgggtatgggagcagggatgaatgcgggcatgaatatgggaatgatgcaaggtggccagatgcctcctggatcggccatgcctggtggatataaccccatgatgggctctggtggttacccgtcccaacaaccctatggtggtggatatcgatgagatggagctgccttgttgatgtgttagtatacctgctgattttacaaggtaaaagggatggcatcgcaaacccagtgtta

SEQ ID NO: 130 - protein, 911 aa, Populus trichocarpa
MKKVFGQTVRDFKREVNKKVLKVPSIEQKVLDATSNEPWGPHGSLLADIAQASRNYHEYQMIMAVLWKRINDTGKNWRHVYKALTVLEYLVAHGSERAIDEIREHSYQITTLSDFQYIDSSGKDQGNNVRKKSQSLVVLVNDKERIVEARQKAAANRDKFRNASPGGMNRPGSYDDDGRYGNRDEDRNGYGYGKEREYNYRDDERYGKYGDSYGRDGDHNGEERYGRDGYRDDDYQGRSRSIDDYGSRSRSSDRDRDHAFDDDGQSSSRGARADDQSHDGSIAKRLERKFSEQNISGPPSYEEALSESRSPAHSERNGEALAVPAPVASSPPAPRSFSPPAFNAASPPPSNPGQENTFFATPASPADQEVVVADEFDPRGPISAPPTATSVQTASAFTPTSNNAEMDLLGSLSDVFTPNPLAIMPVTSATTTSEADSQTNFSGSMFAATQSPSNVMNQAFEDPFGDSPFKATPTDAFSAQQPTASSAPFQPTMNQNTEMPNAVAPPNGDTFSAMTYSAPNVQPPSTNPHFLPQEMSSSHPETDILADILPPSGPSAVASQAGFSLPSGQHPQPGASVYGNFNSPPGNMVLLAAPHMAPQGQQLSSANFFTQGGSPAPIHSNMSLQPPAGPVVLFNNGNLVPQQGSTAPVVSQFSHHTPTGSAPQYNSGNFLPQHGSTFPVASQFTYQTPPASSPQHNDVLGNLFSQGPNTSMASQTALPSSTGSLAIVPQPSKDKFETKSTVWADTLSRGLVNLNISGPKTNPLADIGVDFDALNRKEKRMEKQPMTPVVSTITMGRAMGSGTGLGRAGAGVLRPPPNPTIGSGMGMGGGVNMGMGMGMGGPGSGIGMGGYGGMQQPMGGVGMGAGMNAGMNMGMMQGGQMPPGSAMPGGYNPMMGSGGYPSQQPYGGGYR

SEQ ID NO: 131 - DNA, 1829 bp, Populus trichocarpa
aatcagacgccaccgatttgcagatccatcatggatttcatcaaagtctttgatcaaacagtccgcgaaataaagagagaggtcaatctcaaggtcttgaaggttcctgaaatcgaacaaaaggtgttggatgccactgatgatgcaccttggggtccacatggctctgcaatggctgagatcgcgcaagctactaaaaaattcacggaatgtcaaatgatcatgaatgtcctgtggacgaggttaggtgagacgggcaaggactggcgtcttgtttacaaggcattggctgtcatagaatatttggtggcacatggatctgatcgtgctgttgatgacataatagaacacacattccagatatcatccctcacaagtttcgaatatgttgagccaaacggaaaggactcaggacttaatgtgaggaagaaggctgaaactattgtatcccttttgaacaataaggataaaatatacgaagtcaggagtaaggctgctactaaccgtgataagtatgttggtctttcatctagtggaatatcttataagtcaagcacagcctcatttggaagcagcagcagcagcttccaaagtagagatcggtatggaggtggcttaagtggtacgggagatgaagatagctatgatagttttaaacaagaaaagagtcgaaaggattcctacacgaagtcacatcgaaggggtataagtgacaatcaagacagcaccttgaaaaagggttctgcaggctttggaagcaaggatcaagataatttgtcttctcgtgcatcaaggtcatctgctaacctaaatgcctctgataagaaaaactcagtttcaagtaattatgatgacgatgattttgatgattttgatccccgaggaacctccagcactaagtctgcttctcaaacctcaaaccaagttgatttgtttggagaaagtttgattggtgatctcatggatgcacctccatctgttcctacagaagctttagtcatgaatgggaattctgcagaggttgatctgtttgctgatgcagcttttgtatcagcacctccccaagctggaaaggaagcaagttcacagactcagacaaaggttgatctgttcacttcccaacctgccaacccttctgcagttccttctacatttgacttcttttctagtgatgaaccagtcgcacaacccgggatcaagactccaaaatctgatcctccaaatactaatgtctttgacccatttgctgcagttccaatgaacaattttgatggatctgatctttttggtgtattcacttctagttctaatccagcttcttcagaaccaactcaaagtcctattaaagatggcagccttgacaatttggatgggaagtctttggcaagctccaatcctccacagaaggagggtttccaggtgaagtctggaatatgggcagattcgcttagccgtggactgattgatcttaatatatctgctcgctcagtcagaattgtcttgccacttgaactccttgcagccaagaaggtgtctcttgtagatgttggtgtcgtgggtgatcttactaatggattagatgaaagggaaaagggacctccaacttcattctatatgggaacagcgatgggcatgggatctggccttggtaaatccgggttaacagcttcacagtcacaagcaactggcggagatgatttcttctcaagccttggtggccaacaataccactttggtaattttaagtaaattctgtcaagtggcctttatcgcccattatgcccgcatattcttttgcccgtttggtaaagatatttcaagtgctgcct

SEQ ID NO: 132 - protein, 572 aa, Populus trichocarpa
MDFIKVFDQTVREIKREVNLKVLKVPEIEQKVLDATDDAPWGPHGSAMAEIAQATKKFTECQMIMNVLWTRLGETGKDWRLVYKALAVIEYLVAHGSDRAVDDIIEHTFQISSLTSFEYVEPNGKDSGLNVRKKAETIVSLLNNKDKIYEVRSKAATNRDKYVGLSSSGISYKSSTASFGSSSSSFQSRDRYGGGLSGTGDEDSYDSFKQEKSRKDSYTKSHRRGISDNQDSTLKKGSAGFGSKDQDNLSSRASRSSANLNASDKKNSVSSNYDDDDFDDFDPRGTSSTKSASQTSNQVDLFGESLIGDLMDAPPSVPTEALVMNGNSAEVDLFADAAFVSAPPQAGKEASSQTQTKVDLFTSQPANPSAVPSTFDFFSSDEPVAQPGIKTPKSDPPNTNVFDPFAAVPMNNFDGSDLFGVFTSSSNPASSEPTQSPIKDGSLDNLDGKSLASSNPPQKEGFQVKSGIWADSLSRGLIDLNISARSVRIVLPLELLAAKKVSLVDVGVVGDLTNGLDEREKGPPTSFYMGTAMGMGSGLGKSGLTASQSQATGGDDFFSSLGGQQYHFGNFK

SEQ ID NO: 133 - DNA, 802 bp, Solanum lycopersicum
  misc_feature (786)..(786): n is a, c, g, or t
aaaaaacagagtagctatttctctcttctcttggcaaagcaagagttgagagagatctcatcggctttatactttttgaagagatctcatccttttttcctttcagtttcagatctctatatctttttccagaattttgaatcaggtttcgcttattgggtagattcagccatggatttcatgaaggtcttcgatcaaacggttcgcgaaataaagagggaggtgaatttgaaagtattgaaagtccctgagatcgagcagaaggtattggatgctactgatgatgagccctggggccctcatggtactgctttggctgagatagcacaggctacaaaaaaattctccgagtgtcagatggtcatgaatgtgctctggacaagattgactgaaactggaaagaactggcgatatgtctataagtcattggctgttatagagtacttggtggcgcatggagctgaacgtgcaattgatgacatcatagaacatacctatcagatctcttctctcacaactttcgagtatgttgagccaaatggtaaggatgtgggaattaatgtgaggaagaaggcggaaaatgttgtggcattattaaataacaaagagaagatacaagaggttaggagtaaagctactgcaaatcgtgagaagtacgttggactatcatcttccggaataacatataaggcaagctctgcctcttttagtagcagcagaagcggcttacagagtagtgaacgggtatggaggttttggaaataaaagcgatggtgattcatttanggatagttataatgaa

SEQ ID NO: 134 - protein, 197 aa, Solanum lycopersicum
MDFMKVFDQTVREIKREVNLKVLKVPEIEQKVLDATDDEPWGPHGTALAEIAQATKKFSECQMVMNVLWTRLTETGKNWRYVYKSLAVIEYLVAHGAERAIDDIIEHTYQISSLTTFEYVEPNGKDVGINVRKKAENVVALLNNKEKIQEVRSKATANREKYVGLSSSGITYKASSASFSSSRSGLQSSERVWRFWK

SEQ ID NO: 135 - DNA, 1754 bp, Triticum aestivum
ccacgcgtccgcggacgcgtgggcggacgcgtgggcggacgcgtgggcggacgcgtgggcgcgcgcgccctccgcccggcaggccgtcgacctcgccgtccgtcgaggtggccgccggccgtcgcgaggaatcgccgctcgccgggatcgggggagccgccgccgcgtctccatcccatccagacacagcctcctaggccactcgctcagcgctcgagagcccagatcccccgctatatagagtccccgtcgacccttcgccgccgcgcaggccatggatttcatgaaggccttcgatcagaccgtaagggagataaagagggaggtcaatctcaaggtgctcaaggtccccgagctcgaacagaaggtccttgacgcgacaagtgatgaaccttggggtccacacgggtctgctctttcagagctagctcaggccaccaagaaatactctgagtgtcagatggtgatgggtgtcctctgggccaggctgggtgagcgagatgcaaactggcgtcatgtgtataaggcactgacgattattgagtacttgatagcgaatggttctgaccgggcagttgatgacattctcgatcattattcaaagatctcggttctttcgagttttgagtttgtggaacctaatggaaaagactctggaataaatgtgaggaagaaagtggaaactctggtggggatcatcaatgataaggagagaataaaggctgtgagagagaaagcggctagtaaccgtgacaagtacgttgggttatcatcaactgggtcatatagatcaagctcagcctctggaggtagcaactacagttcaggtgaacgctatggcagttttggtggcacaagggaggctgattcgttcagtaacagttacagggacaaagaacctgttaaaacctcttcaagtaatactggcaggcgcagatctggcagcaagataagaaaggacgcggatcatgatagaagctcctcgaagtccccatctaacacaaaaggcaatgaggatgaatttgatgactttgatcctcgtggatcttcaaatggtgcagctaatacaaagactgccgaggtggatcttctcggcccaaacttgatggatgatttccttgacgagcctgcagccactccagcagcaaaaagtgctgtagaacctcaggttgatctgtttgctgatgcagatttccaatcggcaatcccaggtgccgaaacaactgcgcatcaggatgtccaggaaactgttgaccttttttcgggaaatgctacctttgcttcagcatttccaccacagactgggtttatccaaccaccaacttctgggacaccttctaatgctaatacttccgtgtccaagaacacagtacctgaaccatttgatcctttcggtgatattcctttaagcagttttgggggatctgacccatttggtgacttcagctcatctagtgcaccaccaccacctgtacacagctctactggaaatatcagcacgtcgagtcagaaccttgaggcagcatcggactttggtgcctttgaatcaaacaccgtggatacagctaaagaccccttcgacttttcttccactggcaattttggcaaagcagatgtagcacctttggcagctcccaaaactgatgcgtctgactttggtgccttcgttgcaaacactgtataagcaactaaagacccctgtgatctttcttcaagtattaatggaagggcagaccaaacacctttggctgctc

SEQ ID NO: 136 - protein, 469 aa, Triticum aestivum
MDFMKAFDQTVREIKREVNLKVLKVPELEQKVLDATSDEPWGPHGSALSELAQATKKYSECQMVMGVLWARLGERDANWRHVYKALTIIEYLIANGSDRAVDDILDHYSKISVLSSFEFVEPNGKDSGINVRKKVETLVGIINDKERIKAVREKAASNRDKYVGLSSTGSYRSSSASGGSNYSSGERYGSFGGTREADSFSNSYRDKEPVKTSSSNTGRRRSGSKIRKDADHDRSSSKSPSNTKGNEDEFDDFDPRGSSNGAANTKTAEVDLLGPNLMDDFLDEPAATPAAKSAVEPQVDLFADADFQSAIPGAETTAHQDVQETVDLFSGNATFASAFPPQTGFIQPPTSGTPSNANTSVSKNTVPEPFDPFGDIPLSSFGGSDPFGDFSSSSAPPPPVHSSTGNISTSSQNLEAASDFGAFESNTVDTAKDPFDFSSTGNFGKADVAPLAAPKTDASDFGAFVANTV

SEQ ID NO: 137 - DNA, 947 bp, Triticum aestivum
tcccgggtcgaccagcggcagtccgatccgccgccgctcgtcccgcctcctcacccaggtctcctaccgaggaggaggaggaggaggagcaggaggaggggaggctgacacccgggtgcgcgcagggggctagctagattcggaagggcgccatgaagaaagtgttcgaccagacggtccgggacctgaaacgcggggtgaataaaaaggtcctcaaggtgcctggcacggaacagaagattctcgacgccacaagcaatgagccgtggggcccccatggatccctcctggcggagatcgcccaagcaacacataactatcatgagtatcagatgatactgaatatcgtgtggaagagggtcagcgatactggtaaaaattggcggcatgtgtacaagggattgattgtcctagattacctggtagcacatggaaccgagcgagttattgatgacataagggagcattcttatcagatatcggcactagctgacttccagtatatcgattctagtgggagagatcaaggtagcaatgtacgacggaaatcccagagcctcgttagtttagttaatgataaggaaaggatactggaagttaggcagaaagcacttgctaccagagacaagtatcggagtgcatttgccacaagtggaccacacaggagtccgggtggatatgacaatgaccgatcgctacgaaggaggtagatatgataacaggaatggctatgggagggaacgagacggatatagagatgatgacagatacagtggcgctggagatacacccaatagggatggagatcaatattctagggattctaatgaacgcaacagggaagatgaatacaacagaggaagtaatagcaaccctgagtatgcagaaggatcaggccgtaggagctacggggatgaggaggcttattcatcccgtggtcgtggcag

SEQ ID NO: 138 - protein, 185 aa, Triticum aestivum
MKKVFDQTVRDLKRGVNKKVLKVPGTEQKILDATSNEPWGPHGSLLAEIAQATHNYHEYQMILNIVWKRVSDTGKNWRHVYKGLIVLDYLVAHGTERVIDDIREHSYQISALADFQYIDSSGRDQGSNVRRKSQSLVSLVNDKERILEVRQKALATRDKYRSAFATSGPHRSPGGYDNDRSLRRR

SEQ ID NO: 139 - DNA, 1683 bp, Arabidopsis thaliana
atggatttcatgaaggtcttcgatcaaactgttcgagagataaaaagggaggtgaatctgaaagttttgaaggtccctgagatggagcaaaaggtattggatgctacagataatgagccttggggtccccatggtactgcattggcagagatagctcaggccacgaagaaattctcggagtgccagatggttatgagtgttttgtggactagactaagtgagacaggaaaagattggcgatatgtctacaaggcattggctgttattgattatctgatttcgaatggatcagaacgagcggttgatgagattattgagcatacttaccaaatatcttcactcacaagttttgagtatgttgaaccaaatgggaaagatgtgggaatcaacgtgagaaagaaggcggaaaacatagtcgctcttttaaataataaagagaaaatctcagaaatcagagacaaagcagtagcaaatcgtaacaagtatgttggcctctcatcaacgggaataacatataaatctggttcctcagcttcatttggtggtagttttcaaagtggttcaagcaattttgacagctacaaggatagagattccagagaagacaagaatgactacgagtcttttcaaaagtcaagacgtggtgttaaaactgaggagcaaagctacacttctaagaagagtttttcacgctatggcagcacggaccatgacaatctatccagtggtaaaaagtcacccgattctgccaaacataggtcatatgtatctgcagctccttcaaacaacgatgatgattttgatgattttgatccacggggaacttccagtaataagccatccacaggcagtgccaaccaagtggacctttttggaggagatctgattggtgacttcttggattctgggccaacagaaacatcttccaccaacaacaacgagaactttcaagaggcggacttgtttgctgatgcagcttttgtatcagcctcggctcagggagctgaatttgggtcacagacacagaaacaagttgatcttttctctgcgtctgaaccttctgtcacagtttcttcagctcctccgacggttgatctctttgcatcttctgaatcagttgtaagcccagaagccaagatatcaatacctgagtctatggctactcccaacattgttgacccatttgctgcagttcctatggataattttgatggatcagatccttttggtgccttcacttcccactcggcttcagtttctacaggtccacaagctccaagtgtacatgggagtgcaacaaacaccacaagcccgctgtctttcgcagactcgaagccacaacatttgcaaaagaaagatcctttccaggtgaaatcaggaatttgggcagattcgctgagccgtggactgattgatctcaatataactgctcccaaaaaagcttctctagctgatgtgggtgttgtgggggatctgagcaatgaagatgggaacaaagcatctgctgcatcgtactactcaggctggtccatgggtgcaggatccgggcttggtaaaactggcctatacagtacacagcagcagcagcaacaacaacaacaacaacaagcacctgatatctcagacgatttcttctccagcctcagtaaccaaaggtaccaatctggtggctttaagcagtga

SEQ ID NO: 140 - protein, 559 aa, Arabidopsis thaliana
MDFMKVFDQTVREIKREVNLKVLKVPEMEQKVLDATDNEPWGPHGTALAEIAQATKKFSECQMVMSVLWTRLSETGKDWRYVYKALAVIDYLISNGSERAVDEIIEHTYQISSLTSFEYVEPNGKDVGINVRKKAENIVALLNNKEKISEIRDKAVANRNKYVGLSSTGITYKSGSSASFGGSFQSGSSNFDSYKDRDSREDKNDYESFQKSRRGVKTEEQSYTSKKSFSRYGSTDHDNLSSGKKSPDSAKHRSYVSAAPSNNDDDFDDFDPRGTSSNKPSTGSANQVDLFGGDLIGDFLDSGPTETSSTNNNENFQEADLFADAAFVSASAQGAEFGSQTQKQVDLFSASEPSVTVSSAPPTVDLFASSESVVSPEAKISIPESMATPNIVDPFAAVPMDNFDGSDPFGAFTSHSASVSTGPQAPSVHGSATNTTSPLSFADSKPQHLQKKDPFQVKSGIWADSLSRGLIDLNITAPKKASLADVGVVGDLSNEDGNKASAASYYSGWSMGAGSGLGKTGLYSTQQQQQQQQQQQAPDISDDFFSSLSNQRYQSGGFK

SEQ ID NO: 141 - DNA, 2663 bp, Zea mays
tcctctctgctcacgagtaaagcctgccgctagcccgcgctctggacgtcgcctcctcccccaccccaccggctgtcgccgcccccgccgacgttacctccttacccgccgcacccccccccccccctgcccccccgtccttgccttggcggatctgcctgcctgtgccgcctggcgctgcctcttatcccgccggccgccgctgcctcacgttagctcctcccccatcgtatccggacctccgcgccgcccccacgcctccctgacttggtggatctgtccaccatccaccggaaacagttggtagccgcctaggtacccacctaccccctaggcgaggcggtaccccgtcgcccagcgcataagcgcgcccaggcgagcgcggaatagctccttttcgaatacactcgagcgaagcttagatctgatctcaaggaacctgcagcttgctgcagccactcctcgccggcgatggatttcatgaaggttttcgatcagactgtgcgtgagataaagagggaggtcaatctgaaggtactcaaggtccccgagatcgagcagaaggtacttgatgcaacaagtgatgaaccgtggggccctcatggaagtgctctttcagaacttgcacacgctaccaagaagttcgctgagtgccagatggtaatgaatgtcctatggactaggttgtctgagagaggcgcgaattggcgtcatgtgtataaggcattaactattatcgagtactttatagccaatggttctgagagggcagttgatgacattcttgatcattattctaagatctcggttctttcgagttttgagtatgttgagcctaatggtaaagacgttggaataaatgtgaggaaaaaagtagaaaccattgtgggcatcataaatgacaaggagaaaataaaggccgtgagagataaagcagccagtaatcgtgataagtacattggactatcatccacaggcataacatataaatcaagctcagcctcatttggtagcaactacagttcaggcgaacgttatgggagtttcagtggtacaaaggaagctgactcatacggtgatagttacagggacaaagaacctgttaaaacttccacaagcaatagcggcagtcggaaatctggcagcaagctgaggaaggatgcgaagcctgataggaggaatgaggattatagttcacccagctctttgagacccccatctaatacaaataacactgaggacgactttgatgactttgatcctcgtggatcagatggcaaaacaactgctaagtcaaatgaggtggatctgtttagcccaaacttgatggacgattttattgatgcatctgcagcaactccagcaacagacaatgctgcagaaccacaggttgatctgtttgctgatgcagattttcaatcggcaaccgcaagtacagatacagctgcaaatacagatgtcaaggtcaatgttgacctttttgcggaaaaggcatcttttcctgcagcatttccaccacaggctgggtttattccaccaccaagtgccgggacatcttctgaagtaaatacttccgtatccaagaaggcagctccggaaccttttgatccttttggcgctattcctttgaacagttttgatggacctgacccatttggtggcttcagctcaaatgctggatcatctaccgcagcagcacccacccacggttcaactggaaatatcagcacatcgaaccagaaccttcatgctgcaaccgactttgctgcctttgtatcaaacaatgagggagcagcgaaagacccattcgatctttcttcgagtgccaatgtcggaaaaacacctttggcagctcccaagatcgacgcatctgatttcggtgcatttgtatctagcaccgaggaagcagccaaggaccctctcgatctttcttcgggtagcaaccttggaaggacaggccaagcacccgcggcagcctccaaggctaacgcaaagaaagacaattttcaggtcaagtccggcatatgggcagactcgctgagccggggattgattgatctgaacataactgcaccgaagaaggtgaacctagctgatattggcatcgtcggtggccttggcgatgggtccgatgagaaggccctgccctcttggaccatgggcgccgtatccggcctaggaatgtctggtattccaccgtcaacacaacaagctggtggcatcgagagcttggccaactacaacaagcatcatttcggcttcaaataggcctcgatctttcatactggaaaatacccgtcatctgcggtttcctcctctgtcggcctgcttcttacatgtgctgccctattgatttaatcaccttttgttttgttttgttttttgttttggtgattacattacatggtatcgaccaatcttggccccgtcttgtcacgcgtgtatgttatttgtcgggtttgtgggtaagcatgcaactacatacacatcacaccccctgtgttccagctcgatgataggtggtatgttggccatgcagtttgtgtaaattccgtggcctgccttctctacttcacacagtactctacgcagcgatttgcagtgcttgagtttatattcaataataagagaacctatgccctttatgtctcgaaaaaaaaaaa

SEQ ID NO: 142 - protein, 598 aa, Zea mays
MDFMKVFDQTVREIKREVNLKVLKVPEIEQKVLDATSDEPWGPHGSALSELAHATKKFAECQMVMNVLWTRLSERGANWRHVYKALTIIEYFIANGSERAVDDILDHYSKISVLSSFEYVEPNGKDVGINVRKKVETIVGIINDKEKIKAVRDKAASNRDKYIGLSSTGITYKSSSASFGSNYSSGERYGSFSGTKEADSYGDSYRDKEPVKTSTSNSGSRKSGSKLRKDAKPDRRNEDYSSPSSLRPPSNTNNTEDDFDDFDPRGSDGKTTAKSNEVDLFSPNLMDDFIDASAATPATDNAAEPQVDLFADADFQSATASTDTAANTDVKVNVDLFAEKASFPAAFPPQAGFIPPPSAGTSSEVNTSVSKKAAPEPFDPFGAIPLNSFDGPDPFGGFSSNAGSSTAAAPTHGSTGNISTSNQNLHAATDFAAFVSNNEGAAKDPFDLSSSANVGKTPLAAPKIDASDFGAFVSSTEEAAKDPLDLSSGSNLGRTGQAPAAASKANAKKDNFQVKSGIWADSLSRGLIDLNITAPKKVNLADIGIVGGLGDGSDEKALPSWTMGAVSGLGMSGIPPSTQQAGGIESLANYNKHHFGFK

SEQ ID NO: 143 - DNA, 921 bp, Synechococcus sp.
atggaatcgcgtttgaaaccaggtttgattgtcctctgtgggccaacggcggcaggaaaatcgagtttggcgatcgcgatcgcccagcgtttgggcagcccaattttgagtgctgattcgcggctggtttatcgcgactttaatattggcaccgccaagcccacccctgccgagcagcagcaggtgccccactatttaatggatctctgtgatccccgccaagtttttaccgttggggattatcaagattgtgcagtgccactgattcagcaactccaggaaaaaggaatgctgcccttgttggtagggggtacaggtctctacatcaaagcgatcgtcaacggtttacgctttccccgcattgcaccgcagcctaagctgcgatcgcaacttcaagcgttaggtcagccactctgtcatgccctattacagcgggttgatccggtggctggcgaccgaattcatgtcagtgatcgcgttcggaccttgcgagccttagaagtcttctatgtcagtggcgatcgcctgacggatctgcagcaggagcaaccgccgagctatccaattctgcagattggcttggatagcgatcgcttagaagccaggattcagcagcgcacccagcagatgttaacgtcgggcttcgttgaggaagtgcaaggattgtgcgatcgctacggtagcgatctgccgctgctcaataccctgggctatcgccaggtttgtgcttttctacagggaagtttgagtcggtcagagttgccagagcaaatcgtcctgcagacgcgccagtatgccaaacagcagcgcacttggttccgggccgattcatcgattcagtggattgatgccgaagccagcaatcgcctggagcgggcgctagacctgattgagcgcttccgaaagagtgagggcgtttga

SEQ ID NO: 144 - protein, 306 aa, Synechococcus sp.
MESRLKPGLIVLCGPTAAGKSSLAIAIAQRLGSPILSADSRLVYRDFNIGTAKPTPAEQQQVPHYLMDLCDPRQVFTVGDYQDCAVPLIQQLQEKGMLPLLVGGTGLYIKAIVNGLRFPRIAPQPKLRSQLQALGQPLCHALLQRVDPVAGDRIHVSDRVRTLRALEVFYVSGDRLTDLQQEQPPSYPILQIGLDSDRLEARIQQRTQQMLTSGFVEEVQGLCDRYGSDLPLLNTLGYRQVCAFLQGSLSRSELPEQIVLQTRQYAKQQRTWFRADSSIQWIDAEASNRLERALDLIERFRKSEGV

SEQ ID NO: 145 - DNA, 909 bp, Acaryochloris marina
atgacgccagggttgatcgtaatttgtgggccaacggctaccggaaaatcctctctggcattggctttggcccgacgtttaggtgctcccattctcagtgcagactctcggcaagtctatcgggggtttgatattggtactgcgaaaccttctgtaacggatcaagaagatgttcctcactatctcattgatatatgtgaccctactgagactttgacggttgccgactaccaagagcaggctcaggcgctcattgctcagtttcatactgaggggcaaacgccgattctcgtgggggggactggactgtatatccgggcgattgtggaggggctgaagattccgcgggtaccgccgcaactggagttgcgatcgcaactccaatcccaaggccaggtccagatttaccaatggctccagcaagtcgatccaccagcagcccaaaaaattcatgcccatgaccaagtccgtaccctaagagcattagaagtcttttacaccacgggcatccccctatcagcacagcaaggcaagaatcccccgtcctatcccatcttgcaaattggcttagatattagtgatctggaccagcataccgacatcattcagcagcgcacggctgccatggtggagcagggttggttgactgaagtccaaaaactcatcgaccactatggggtcgaactccccctcttagcaaccctgggctatcaagaaatgaaggcctatctgcatcagcaaatcaccctagaagaagcaaccgcccaaactattcttcatactcgtcaattcgccaagcgccaacgcacctggtttagagcgaattctggcattcactggtttgatgccacgaattctgacttactttctctagtttggaaggatattcaaggtcaaccttggctgtaa

SEQ ID NO: 146 - protein, 302 aa, Acaryochloris marina
MTPGLIVICGPTATGKSSLALALARRLGAPILSADSRQVYRGFDIGTAKPSVTDQEDVPHYLIDICDPTETLTVADYQEQAQALIAQFHTEGQTPILVGGTGLYIRAIVEGLKIPRVPPQLELRSQLQSQGQVQIYQWLQQVDPPAAQKIHAHDQVRTLRALEVFYTTGIPLSAQQGKNPPSYPILQIGLDISDLDQHTDIIQQRTAAMVEQGWLTEVQKLIDHYGVELPLLATLGYQEMKAYLHQQITLEEATAQTILHTRQFAKRQRTWFRANSGIHWFDATNSDLLSLVWKDIQGQPWL

SEQ ID NO: 147 - DNA, 885 bp, Anabaena variabilis
atgactaaattaatcgtaatttgtggagctacggcgacgggtaaatctggtttggctttgaacttagccatgcggttgggttctgtgattttgagtgctgattctcgtcaagtgtatcgtgaatttgatattggtacagcgaagccaacgctggcagaacaaaaagccgttcctcattatctaatagatatctgcactcccagagaaacgatgacagttgcagattatcaagaacaggcacaagcactaattaattctctgccagtttcgccgttattgttagtgggaggtactggtttatatatacgttctattgtgcaggggatgaagatccccagggttgcgccgaattatgaattgcgatcgcaactcgaatctttaggtcaaactacactctacggcatattacaacaagttgatcccgttgcggctcaaaagattcatccccatgatcctgtacggactttacgggcagtagaagtattttacgttactggcattcccatatcggcacagcaaggagaaaatcccccagattaccctattttacaaattggattagattgtgaaatggaaagattgagtgagcgcattcacaaacgcactgaacaaatgatagcagatggcttagttggagaagttgaatatctgtgccaaaaatatggtgctgatttacccttgttaaatactttaggatatcaagaaattaagcaatatttagctggagaaatttccttagaagcagccaaagaattaatcgtactgcatacaagacaatttgccaaacgccaacgcacctggtttagagcctatccccaaattgagtggtttaatgcagatgatgctgatttattagatattgtttggcagcgcatacaacagtag

SEQ ID NO: 148 - protein, 294 aa, Anabaena variabilis
MTKLIVICGATATGKSGLALNLAMRLGSVILSADSRQVYREFDIGTAKPTLAEQKAVPHYLIDICTPRETMTVADYQEQAQALINSLPVSPLLLVGGTGLYIRSIVQGMKIPRVAPNYELRSQLESLGQTTLYGILQQVDPVAAQKIHPHDPVRTLRAVEVFYVTGIPISAQQGENPPDYPILQIGLDCEMERLSERIHKRTEQMIADGLVGEVEYLCQKYGADLPLLNTLGYQEIKQYLAGEISLEAAKELIVLHTRQFAKRQRTWFRAYPQIEWFNADDADLLDIVWQRIQQ

SEQ ID NO: 149 - DNA, 909 bp, Gloeobacter violaceus
gtgaaaaaaatcgtcgtcgtctgcggccccaccgccgccggcaaaagccaactgggaatgcatctggcccagcacctgggggtaccggtgctgagcgccgattcccggcaggtctaccgcgagttcgacatcggcactgctaaaccgacccgtgaagaacaacgccgcgtcgagcactgcctcatcgatgtcgcctggcccacggaacatttcaacgtggcgcgctaccgggaactggccgatgcggagattgaccggctgacccggcaaggcaaacccgccctactggtgggaggcagtggtttgtacctgcgcgcggtatcgggcggactcgaaccgcccgccgtcccccccgacccggctttgcgcgcccgcctggcggttgagcggttggacgcactttaccagcgacttcaacagctcgatcccgaatccgcggggcgcatccaccccaacgaccaggtgcgcatcgagcgcgccctcgaagtgtgcctgacaaccggccaaccgctgagtgcccagcgccgcctgcgggcgcgagatttttcgctcctcgccctgggggtgggcagcggccgggaagcgctggtgcgccgcatcgagcagcgcacccaccggatgatcgaagcgggttggctggaggaagtcgagtatctgcgcgccaaatacggccccgatttgccgcttctgagcaccctcggttacgccgagttgggggcgtacctggaggagcgatgggatctggcggaggcgctccagcagatcgtcgtgcatacccgccagttcgccaagcgccagatgacctggtttcgcgccgagcccgatgttcattggctcgatgaatcggcaggacggcagacacttgaacaacagagtatcgaacaggttgagcgctttcttgccggttga

SEQ ID NO: 150 - protein, 302 aa, Gloeobacter violaceus
MKKIVVVCGPTAAGKSQLGMHLAQHLGVPVLSADSRQVYREFDIGTAKPTREEQRRVEHCLIDVAWPTEHFNVARYRELADAEIDRLTRQGKPALLVGGSGLYLRAVSGGLEPPAVPPDPALRARLAVERLDALYQRLQQLDPESAGRIHPNDQVRIERALEVCLTTGQPLSAQRRLRARDFSLLALGVGSGREALVRRIEQRTHRMIEAGWLEEVEYLRAKYGPDLPLLSTLGYAELGAYLEERWDLAEALQQIVVHTRQFAKRQMTWFRAEPDVHWLDESAGRQTLEQQSIEQVERFLAG

SEQ ID NO: 151 - DNA, 936 bp, Microcystis aeruginosa
atgtcaactattctgattgttatttgtggggcaactgccacaggaaaatccagtttagccctacaattggccaaaaagtttaattcagtaattctcagtgccgattcccgacaaatctatcgagaatttaatattggtactgctaaacctagcttagaagaatgtcagcggattccccattatctaattgatatttgtgatcctcaagataattttaccctagcacagtaccaagaacaggctgagaatttaatcagcaatctccactattctcctctgtttttggtcggtggtacgggactttatatcaagtccattgtcaaaggtttaaaaataccgagggtttctcctcaagcggatttaagacggcaattacaagctttaggacaatcctatctttatcaaattctgatgcaggtagatgaagaggccgctaaaaaaattcatccccatgatcaggtcaggactttacgcgctttagaggttttttatgtgacaggaaaacctatctctagtcagcagggagaaaatccccccacttatccgattttacaaattggtttagactgttccccagaaagtttagacaagcggatcactgttcgtactcatcaaatgatcgccaagggattagtagcagaggtgcagaatttgggggataaatacggttgggatttgccacttttgcagactttgggttatgcagagattaagcaatatctcctcggagaagtttctttagaacaggcgatcgatctaattatcctccacacccgtcaatttgccaaacgtcagcgcacttggtttcgtgccgatgctgatattgtctggtttcccgtcgataaagaaaatttattggaattggtggaacgaaaaattattttgtttcttgaggggttgtcaaggcccgatataaaaacacatcatcctgattaa

SEQ ID NO: 152 - protein, 311 aa, Microcystis aeruginosa
MSTILIVICGATATGKSSLALQLAKKFNSVILSADSRQIYREFNIGTAKPSLEECQRIPHYLIDICDPQDNFTLAQYQEQAENLISNLHYSPLFLVGGTGLYIKSIVKGLKIPRVSPQADLRRQLQALGQSYLYQILMQVDEEAAKKIHPHDQVRTLRALEVFYVTGKPISSQQGENPPTYPILQIGLDCSPESLDKRITVRTHQMIAKGLVAEVQNLGDKYGWDLPLLQTLGYAEIKQYLLGEVSLEQAIDLIILHTRQFAKRQRTWFRADADIVWFPVDKENLLELVERKIILFLEGLSRPDIKTHHPD

SEQ ID NO: 153 - DNA, 888 bp, Nostoc sp.
atgactaaattaatcgtaatttgtggtgctacggcgacaggtaaatctggtttggctttgaacttagctatgcggctgggttctgtgattctgagtgctgattctcgtcaagtgtatcgtgaatttgatattggtacagcgaaaccaacgctagcagaacaaagagccgtccctcattatttaatagatatctgcgctcctagagagacgatgacagttgcagattatcaagaacaggcacaagcattgattaattctttgccagtctcgccgctattgttagtgggaggcacaggtttatatatacgttctattgtgcaagggatgaagatccccagggttgcgccgaattatgaattgcgatcgcaactcgcctctctaggtcaaactacactctacggcatattacaacaagttgatcccattgctgcccaaaaaattcatcccaatgaccctgtgcgaactttacgcgcagtagaagttttttacattactggcattcccatatcggcacagcaaggagagaatccgccagattacccaattttacagattgggttagattgtgaaatggaaagactgactgagcggattcacaaacgcactgagcaaatgataacagatggcttagttggagaagttgaatatctttgccaaaaatatggtgctgagttacccttgttaaatactttaggttatcaagaaataaagcaatatttaactggggaaatttccttagaagcagccaaagaattaactgttttgcatacacgacaatttgccaaacgccaacgcacctggtttagagcatctccccaaattgagtggtttaatgcagatcatcctgatttattagatattgtttgccagcacatacaacaaccgtag

SEQ ID NO: 154 - protein, 295 aa, Nostoc sp.
MTKLIVICGATATGKSGLALNLAMRLGSVILSADSRQVYREFDIGTAKPTLAEQRAVPHYLIDICAPRETMTVADYQEQAQALINSLPVSPLLLVGGTGLYIRSIVQGMKIPRVAPNYELRSQLASLGQTTLYGILQQVDPIAAQKIHPNDPVRTLRAVEVFYITGIPISAQQGENPPDYPILQIGLDCEMERLTERIHKRTEQMITDGLVGEVEYLCQKYGAELPLLNTLGYQEIKQYLTGEISLEAAKELTVLHTRQFAKRQRTWFRASPQIEWFNADHPDLLDIVCQHIQQP

SEQ ID NO: 155 - DNA, 900 bp, Prochlorococcus marinus
atgcaaaacccaaaaccattggtaatagttttgcttggaccaacagcaagcgggaaaactgatctagctatacaaatagccaaaaagataaaagtaagtattcacaatattgattcacgtcaattatataaaggaatgaatattggtactgctaaaccaacgatagagcagcaagaagaaataaagcattatctactagatcttaaagatcctaataaccccatcacattgcatgaattcaaaaaagaagcagagttgagcctaaagaatatttttagcaaagaaaagtgtggctttttggtcggcggaagtggcctctatttaaaatctctaacaagtggtttatgcccaccatctgttccagcacaagaaaaactccggaaagagtttagaagacttggacaaaaagagtgtcatcaaatactgaaaaaatgtgatcccattgcttgggaaaaaatttcccctagagattctattagaacaataagagcattagaagttttctattccactggacagacaataagctcattaaaaactttaaagcctcctgactggaatttattagagctagggttagatccaagaaatcttcaacaaagaattgctaaaagaacaaaaatattgttccaaaaaggtcttattgatgaaactaaagctttaattcatcaatatggagaagatcttcctttgctacagacaattggatacaaagaagcttgcacagtaataaaaggcgaatattcaattacagaagcaatcgaaatcacaacccaacgaacgaatcaatttgctaagaagcaaaggacttggtttagaagacaacataatccaaaatggctaaatgaaaaaaactctcttgaagaagctctctctttgatccaaaacgttatagggtga

SEQ ID NO: 156 - protein, 299 aa, Prochlorococcus marinus
MQNPKPLVIVLLGPTASGKTDLAIQIAKKIKVSIHNIDSRQLYKGMNIGTAKPTIEQQEEIKHYLLDLKDPNNPITLHEFKKEAELSLKNIFSKEKCGFLVGGSGLYLKSLTSGLCPPSVPAQEKLRKEFRRLGQKECHQILKKCDPIAWEKISPRDSIRTIRALEVFYSTGQTISSLKTLKPPDWNLLELGLDPRNLQQRIAKRTKILFQKGLIDETKALIHQYGEDLPLLQTIGYKEACTVIKGEYSITEAIEITTQRTNQFAKKQRTWFRRQHNPKWLNEKNSLEEALSLIQNVIG

SEQ ID NO: 157 - DNA, 900 bp, Prochlorococcus marinus
atgtcgtcatcaaaaccactcataattgttctccttggacctactgctagcgggaaaactgcactagggatagaaatagctgagcatctgggactcgagatacataatgttgattctcgtcaggtttatatggatatggacatcgggaccgcaaaaccatcccaagaacagcaaaaacgtataagacatttcttgattgatttaaagccgcctaatgaaaaaatgacaatgcatgatttccataaaacagcaagagtcagcttggataatgcattaaataaaacaaacgttggattacttgttggtggaagtggtctgtatctcaaagccttaactagcggtctatgccctccatccattcctcccgaatcaagttttaggaaacaattacatgacattggtcaagagcagtgttatcaacttctccaaagctgcgacccactgagcgcgaaaaccattgctccatcagactcagtcagaacaacaagagcactagaagttttttatgcaactggtcaatctaaaacttcccttcaatcttccaaaccacctccctggaggttattagagctaggacttaatccaagtaatctcaatgatcgcattgcacaaagaacagaaaacatttttcaaaacggtcttattgaagaaactgaacacctcattggaaaatttggaaaggaattgcccttgctaaacactattggatatgcagaggcatctcaaatgattgatggcaagcttcccttaaatgacgccatatttcaaacaaataaaagaactaagcaatttgcaaaaagacaaaaaacttggtttaggggtcaacacaatccaaaatggttaaatgagaaaaacccacttagtgaagctctctctttgatccataacgttataaggtga

SEQ ID NO: 158 - protein, 299 aa, Prochlorococcus marinus
MSSSKPLIIVLLGPTASGKTALGIEIAEHLGLEIHNVDSRQVYMDMDIGTAKPSQEQQKRIRHFLIDLKPPNEKMTMHDFHKTARVSLDNALNKTNVGLLVGGSGLYLKALTSGLCPPSIPPESSFRKQLHDIGQEQCYQLLQSCDPLSAKTIAPSDSVRTTRALEVFYATGQSKTSLQSSKPPPWRLLELGLNPSNLNDRIAQRTENIFQNGLIEETEHLIGKFGKELPLLNTIGYAEASQMIDGKLPLNDAIFQTNKRTKQFAKRQKTWFRGQHNPKWLNEKNPLSEALSLIHNVIR

SEQ ID NO: 159 - DNA, 900 bp, Prochlorococcus marinus
atgtcttcatatccaactcctgtaataattttaattgggccaactgcaagtggcaaaacagaattagctattaaaattgcagaatattttaaaactagtattcacaatatcgattcgagacaaatatataaatttatggatattggaaccgccaagccatctaaagaccaacaaaaaaaaataaagcattttttaatagatatagaggagccaatcaatcaaattaatgtgcaacaatttcaaaaaattgctcaaaaatcaataaaaagagaaataaatcaagacaatctaccttttcttgttggggggagtggtttgtatatgaactcaataacaaaaggtttttttataccagatattcctcctcaaaataatttgagaatacaattagaagaacttggccaaaaaaaatgttgggaactcttaaataattgtgatccattatcaacaaaaaacatcagttttgctgatcgcattagaacaataagagctttagaagttttctatgtaacgggtaaacctttgtcaactctaaaagttcaaaatccgcctaattggaaagtactagagcttggattagatagagataacttaaaagaaagaattttacaaagaacaaaaaatatttttctttcgggaattattgaagaaacaaaccaccttatctctaaatacggatttgatttgccaatattagaaaccattggttatcgagaagctaaggatgttttaaagaaccattcaacaatcgacaaggcgattgaattaactacgacaaaaacgatccaatttgccaaaagacaaaaaacttggtttcgcaataaaaataatcctatttggctgaataacaaaaacctactaaaagatgcaataattaagatagagtcttttttaagctaa

SEQ ID NO: 160 - protein, 299 aa, Prochlorococcus marinus
MSSYPTPVIILIGPTASGKTELAIKIAEYFKTSIHNIDSRQIYKFMDIGTAKPSKDQQKKIKHFLIDIEEPINQINVQQFQKIAQKSIKREINQDNLPFLVGGSGLYMNSITKGFFIPDIPPQNNLRIQLEELGQKKCWELLNNCDPLSTKNISFADRIRTIRALEVFYVTGKPLSTLKVQNPPNWKVLELGLDRDNLKERILQRTKNIFLSGIIEETNHLISKYGFDLPILETIGYREAKDVLKNHSTIDKAIELTTTKTIQFAKRQKTWFRNKNNPIWLNNKNLLKDAIIKIESFLS

SEQ ID NO: 161 - DNA, 900 bp, Prochlorococcus marinus
atgtcttcacatccacctcatgtaatagttttaattgggcctactgcaagtggcaaaacagaattagctattgaaattgcagaatattttaaaactaatatacacaatatcgattcaaggcaaatatataagtccatggatattggaacagccaagccatctaaaatccaacaaaaaaaaatacggcattttttaatagatattgaagaacctatcaatccaattaatgtaaaacaatttcaagaaattgctcagaaatcgatcaaagaagaaattaaaaaagataaattaccttttcttgttggaggaagtggtttgtatatgaactcaataacaaaaggttttttcgtaccagatgtccctcctcaaaataatttaagaaaacaattagaagaacttggtcaggaaaaatgttgggacctgttagaaaattgtgatccattatcaacaaaaaaaatcaattttgctgaccacgttcgaacaataagagctttagaagtcttctacgtaacaggtaagcctttatcaactctgaaagttcagaaaccacctaactggaaaatcttagagcttggattagacagaggtaatttaaaagaaagaatttttcaaagaacaaaaaatatgtttttatctggaataattgatgagacgaatcaccttatctctaaatacggatttgatttgccaatattagaaacaattggctatcgagaagctagaaatgttttaaataaccattcaacaattgacaaagcgattgagttaactgcaacaaaaacaatccaatttgccaaaagacaaaaaacttggtttcgtaataaaaataatcctctttggcttaataacaaaaacccgctaaaagatgcaataattaagatagagtcttttttaagctaa

SEQ ID NO: 162 - protein, 299 aa, Prochlorococcus marinus
MSSHPPHVIVLIGPTASGKTELAIEIAEYFKTNIHNIDSRQIYKSMDIGTAKPSKIQQKKIRHFLIDIEEPINPINVKQFQEIAQKSIKEEIKKDKLPFLVGGSGLYMNSITKGFFVPDVPPQNNLRKQLEELGQEKCWDLLENCDPLSTKKINFADHVRTIRALEVFYVTGKPLSTLKVQKPPNWKILELGLDRGNLKERIFQRTKNMFLSGIIDETNHLISKYGFDLPILETIGYREARNVLNNHSTIDKAIELTATKTIQFAKRQKTWFRNKNNPLWLNNKNPLKDAIIKIESFLS

SEQ ID NO: 163 - DNA, 900 bp, Prochlorococcus marinus
atgcccgcctctaagccgcttctgattgcgctgctagggccgacagcaagcggcaaaacatgcctggccttacagctggcagaacagctgaagctgagcgtgctcaatgtggattcccgccagctctacatcggcatggacgttggcaccgccaagccaaccaaagaacaacagcggcgcgtgcaacatcacctgattgatcttcgtcgcccagatcaaccgatcaccctgcaggaattccaggcagccgcgcaactgatccttgcgcaaaagctaagggaacaaaacatgccatttctagttggcggcagtggtctttatctcaaagctctcacttgtgggctgcgcccaccagcagtgccaccccaaccagagctccgcaagcagttaggcgagctaggacaacgcacctgccaccacctactccaagccgccgatcccaccgctgccagccgaattgcccctgctgatgccatgcgcaccaaacgggctctggaagtggtttatgccactggcaaaccgatcaccactcaacaaggctcaagcccacccccttggcgcgttctggaactaggcctcgacccacacaacctgcgcgaacgcattggccaacgcacaacgcagctctatgccaatggtctcatcgaagaaaccgaacacttgagtcagtgctacgacagcgatctgcccttgctgcaaacaatcggctatggggaagcactaaaggtgattcaaggcctactcaaccgtgaacaggccatcgccctgaccacacgtcgtactcagcagttcgccaagcgtcagcgcacatggttccgcagacaacatcacccctattggctcaaaggtgaggaaccgctgagcgaagcgctatcactgattcaagcgggtctaaggtga

SEQ ID NO: 164 - protein, 299 aa, Prochlorococcus marinus
MPASKPLLIALLGPTASGKTCLALQLAEQLKLSVLNVDSRQLYIGMDVGTAKPTKEQQRRVQHHLIDLRRPDQPITLQEFQAAAQLILAQKLREQNMPFLVGGSGLYLKALTCGLRPPAVPPQPELRKQLGELGQRTCHHLLQAADPTAASRIAPADAMRTKRALEVVYATGKPITTQQGSSPPPWRVLELGLDPHNLRERIGQRTTQLYANGLIEETEHLSQCYDSDLPLLQTIGYGEALKVIQGLLNREQAIALTTRRTQQFAKRQRTWFRRQHHPYWLKGEEPLSEALSLIQAGLR

SEQ ID NO: 165 - DNA, 900 bp, Prochlorococcus marinus
atgtcttcttatccccctcatgtaatagttctaattggagccacagcaagtgggaaaacagaattagctatcgaaattgcagaatattttaaaactcgtatacataatatcgattcgagacaaatttataaatctatggatattggaacagccaaaccatctgagaatcaacaaaaaaaaataaagcattttctaatagatatagaagaacctattaatccaattaatgtaaaacaatttcaagaaattgctcaaaaatcaatacaaaaagaaattaagcaaaataatttacctctacttgttggaggaagtggtttgtatatgaacgcaataaccaaaggtttttttgtgccggatgtccctccgcaaaataatttgagagagcaattggaggaacttggtcaaaaagaatgttgggagcttttaaaaaattgtgatccaatttcggcaaaaaaaatcaatcttgctgatcaaattagaacaataagagctttggaagtattttatgtaaccggtaaacctttatcttctcaaaaagttcaaaaaccgcctcaatggaaaatactagagcttggattaaatagagataatttaaaagaaagaatttcacgaagaacaaaaaatatgtttttatctggaattattgaagagacgaaaaatcttatttctcgatatggatctgatttaccaatattagaaactattggttaccgtgaagctaaagatgttttaaataataatttaccgattgataaggcgattgagttaactaatataaaaacgaaccaatttgccaaaaggcagaaaacatggtttcgtaataaaaataatcctatttggcttaataacaaaaacctgctaaaagatgcaataattaagatagagtcttttttagactaa

SEQ ID NO: 166 - protein, 299 aa, Prochlorococcus marinus
MSSYPPHVIVLIGATASGKTELAIEIAEYFKTRIHNIDSRQIYKSMDIGTAKPSENQQKKIKHFLIDIEEPINPINVKQFQEIAQKSIQKEIKQNNLPLLVGGSGLYMNAITKGFFVPDVPPQNNLREQLEELGQKECWELLKNCDPISAKKINLADQIRTIRALEVFYVTGKPLSSQKVQKPPQWKILELGLNRDNLKERISRRTKNMFLSGIIEETKNLISRYGSDLPILETIGYREAKDVLNNNLPIDKAIELTNIKTNQFAKRQKTWFRNKNNPIWLNNKNLLKDAIIKIESFLD

SEQ ID NO: 167 - DNA, 900 bp, Prochlorococcus marinus
atgcccgcctctaagccgcttctgattgcgctgctagggcccacagcaagcggcaaaacatgcctggccttacagctggcagaacagctgaagctgagcgtgctcaatgtggattcccgccagctctacatcggcatggacgttggcaccgccaagccaaccaaagaacagcagcggcgtgtgcagcatcacctgattgatcttcgtcgcccagatcaaccaatcaccctgcaggaatttcaggcagccgcgcaactgatccttgcgcaaaagctaagggaacaaaacatgccatttctagttggcggcagtggtctttatctcaaagctctcacttgtgggctgcgcccacccgcagtgccaccccagccagaactccgcaagcagttaggcgagctaggccaacgcacctgccaccacctacttcaagccgccgatcccaccgctgccaaccgaatttcccctgctgatgccatgcgcactcaaaggggtctggaagtggtttatgccactggcaaaccgatcaccactcaacaaggctcaagcccacccccttggcgcgtgctggaactaggcctcgacccacacaacctccgcgaacgcattggccatcgcacaacacagctctatgccaatggtctcatcgaagaaaccgaacacttgagtcattgctacgacaccgatctgcccttgctgcaaacgattggctatggggaagcactaaaggtgattcaaggcctcctcaaccgtgaacaggccatcgccctgaccacacgtcgtactcaacagttcgccaagcgtcagcgcacatggttccgcagacaacatcacccctattggctcaaaggtgaggaaccgctgagcgaagcgctatcactgattcaagcgggtctaaggtga

SEQ ID NO: 168 - protein, 299 aa, Prochlorococcus marinus
MPASKPLLIALLGPTASGKTCLALQLAEQLKLSVLNVDSRQLYIGMDVGTAKPTKEQQRRVQHHLIDLRRPDQPITLQEFQAAAQLILAQKLREQNMPFLVGGSGLYLKALTCGLRPPAVPPQPELRKQLGELGQRTCHHLLQAADPTAANRISPADAMRTQRGLEVVYATGKPITTQQGSSPPPWRVLELGLDPHNLRERIGHRTTQLYANGLIEETEHLSHCYDTDLPLLQTIGYGEALKVIQGLLNREQAIALTTRRTQQFAKRQRTWFRRQHHPYWLKGEEPLSEALSLIQAGLR

SEQ ID NO: 169 - DNA, 900 bp, Prochlorococcus marinus
atgcttccttcaaaaccactagtaatagttttaatcgggccgacagcaagtggcaaaactgagctagcaatagatatcgctaaatattttaatatccatatacacaatgtagattctagacaaatttatagatttatggacatcggcacagctaaaccaacgaaagttcaacaaagagctataaagcattttttaatagatgttgaagatccctcagtaaaagtaaatgcaaagcaatttcaagaaattgccacaaaatcaataaatcgagaattaaatcagaaaaaaacaccctttctagttggtggtagcggattatatatgaattcaataataaagggattttttgcaccagatgttcctcctcaaagttttctgaggtcccaattcgaaaaattaggtcaagaaaaatgttgggaacttctaaaagtttgtgaccctgaattaacaaaaacaattaattatgccgatcaaataagaaccataagaggtttagaagtcttttatgtaactggtaaaagaatgtcatctcaaagattccaaaaccctcctccatggagaatcttagaattgggtataaatagagtagatttaaaggaaagaattttcaaaagaacaaaaaacatgtttgaatttggaattatagaggagaccaaaaatatcattaatcaatatggatcgactttgcctttactagaaacgattggatataaagaggcaaaaaatgtaatcaaagaaaatttaacaattgaagaagctattgaattaacaacaactaaaacaatccaatttgctaaaagacaaaaaacatggttccgtaataagaacaatgcaatatggcttaacaacaaaaacctactaaaagatgcaataattaagatagagtatgctttaggttaa

SEQ ID NO: 170 - protein, 299 aa, Prochlorococcus marinus
MLPSKPLVIVLIGPTASGKTELAIDIAKYFNIHIHNVDSRQIYRFMDIGTAKPTKVQQRAIKHFLIDVEDPSVKVNAKQFQEIATKSINRELNQKKTPFLVGGSGLYMNSIIKGFFAPDVPPQSFLRSQFEKLGQEKCWELLKVCDPELTKTINYADQIRTIRGLEVFYVTGKRMSSQRFQNPPPWRILELGINRVDLKERIFKRTKNMFEFGIIEETKNIINQYGSTLPLLETIGYKEAKNVIKENLTIEEAIELTTTKTIQFAKRQKTWFRNKNNAIWLNNKNLLKDAIIKIEYALG

SEQ ID NO: 171 - DNA, 900 bp, Prochlorococcus marinus
atgtctagagaccttcctaatgtcataattttgattgggcctactgcaagtggcaaaacagaattagctattgaaattgcagaatattttaaaactcatatacataatatcgattcaaggcaaatttataagtccatggatattggaacagccaagccatctaaaaaccaacaaaaaaaaatcaagcattttttaatagatattgaggagccaatccatccaattaatgttaaacaatttcaaggaattgctcaaaaatcaataaaaagtgaaattaaacaaaataatctaccttttcttgttggaggtagtgggttgtatatgaactcgataacaaaaggtttttttgtaccagacgtcccacctcaaaatgatttgagaaaacaattggaagaacttggtcagaaaaaatgttgggacttattaaaaaattgtgatccattatcaacaaaaaaaattaattttgctgaccatattagaacaataagagctttagaagtcttttacgtcacaggaaaacctttgtcaactttgaaagtgcaaagggcgcctgactggagaatactagagcttggattagatagagataatttaaaagaaagaatattacaaaggacaaaaaatatgttttcagcgggaattattgaagagacaaactacctcatctctaaatacggatttgatttgccaatattagaaaccattggatatcgagaagctaaggatgttttaaaaaaccattcaaccattgacaaagcaattgagttaactacgacaaaaactatccaatatgcaaaaagacaaaaaacttggtttcgtaataaaaataatcctctttggcttgataacaaaaaccttctaaaagatgcaataattaagatagagtcttttttaagctaa

SEQ ID NO: 172 - protein, 299 aa, Prochlorococcus marinus
MSRDLPNVIILIGPTASGKTELAIEIAEYFKTHIHNIDSRQIYKSMDIGTAKPSKNQQKKIKHFLIDIEEPIHPINVKQFQGIAQKSIKSEIKQNNLPFLVGGSGLYMNSITKGFFVPDVPPQNDLRKQLEELGQKKCWDLLKNCDPLSTKKINFADHIRTIRALEVFYVTGKPLSTLKVQRAPDWRILELGLDRDNLKERILQRTKNMFSAGIIEETNYLISKYGFDLPILETIGYREAKDVLKNHSTIDKAIELTTTKTIQYAKRQKTWFRNKNNPLWLDNKNLLKDAIIKIESFLS

SEQ ID NO: 173 - DNA, 900 bp, Prochlorococcus marinus
atgttccaaccaaaaccattagtaatagttttaatcggacctacagcgagtggcaaaactgagctaggaatcgaaattgctaaatattttaatctcaatatacataatgtcgactcaagacaactttatcgatttatggacataggtacagcaaagccaactaaagaacaacaaaaaacaataaagcattttttaatagatcttgaagaaccctctagccaagtaaatgcaaaacaatttcaagaaattgctaccaaatcaataaatcgagaactaaatcaaaacagaattccttttctaataggcgggagcgggctatatatgaattcaataataaagggtttctttgctccgaatgtgccccctcaaaaagttttaagatcacaattcgaaaaactagggcaagaaaaatgttgggaacttttaaaaatttgtgatcctgtcttaacaaaaaaaatcaattacgctgatcaagttagaacgataagagctttagaagtcttttatgtaacgggcaaaccaatatcctctcaaaaattccagaaccctcccccatggaaaatattagaattaggtctatacagagaagatttaaaagaacgtattttcaaaagaacaaaaaatatgtttgaatttggaattatagatgagaccaaaaagattattaatcaatatggatcaaatttacctttactagaaacgattggatatagagaagccaaggatgtaataaaggaaaatttaaaacttgaaaaagctattgaaataactacaacaaaaacaatccaatttgctaagagacaaaaaacatggttccgtaataaaaacaatccaatatggcttaataacaaaaacctactaaaagatgcaataatcaatataaagcatgcattacgctag

SEQ ID NO: 174 - protein, 299 aa, Prochlorococcus marinus
MFQPKPLVIVLIGPTASGKTELGIEIAKYFNLNIHNVDSRQLYRFMDIGTAKPTKEQQKTIKHFLIDLEEPSSQVNAKQFQEIATKSINRELNQNRIPFLIGGSGLYMNSIIKGFFAPNVPPQKVLRSQFEKLGQEKCWELLKICDPVLTKKINYADQVRTIRALEVFYVTGKPISSQKFQNPPPWKILELGLYREDLKERIFKRTKNMFEFGIIDETKKIINQYGSNLPLLETIGYREAKDVIKENLKLEKAIEITTTKTIQFAKRQKTWFRNKNNPIWLNNKNLLKDAIINIKHALR

SEQ ID NO: 175 - DNA, 900 bp, Prochlorococcus marinus
atgcaacccaataagcctcttgtcatagcccttatgggcccaactgcaagtggtaaaactgaacttgcaattgatattgcaaaaaaaatcaattctaatattcacaatatcgattctcgccaaatctatattgatatggatattggcaccgcaaagccaacagcagttcaacaaagccaagtaaaccatttccttattgatgtttgcttgccatctaaaccaatcaatcttcatgattttcaatccatagcccaaacatccattgagagagatttagaaaaaaagggtttaacgttacttgtaggaggaagtggcttatatcttcaagccttaattggaggacttaatcctccagctgtacctcctcagaaattcttaagagatcaacttaaaaaaatcgataaaaccgaactacacaaattattaaagctttgtgaccctttttcagcgcagagaatacatccagaagactcaataagaatcattcgtgctcttgaagttttttatgccacgggaaaaatgttttcgaaggaaaaaaacatgacgcctattccttggagagtgttagaacttggagtaaatcctgaaaatttaatcagtagaattcaacgtagaactgaagaaatgtataaaaaaggtttaatagaagaaacagaagatttgatcaataaatacggaaaaaatttacagttgcttaaaactattggatatggtgaagcaaggtctatgattaatggaaagattaattatgaggaggctttagaaataacaatcaaacgaacttgccaattagccaaaagacaaaaaacttggtttagaaataagcatcattctaaatggctaaataatgagaatgcattacccgaagctttaacttctatctatgagtttctaggttga

SEQ ID NO: 176 - protein, 299 aa, Prochlorococcus marinus
MQPNKPLVIALMGPTASGKTELAIDIAKKINSNIHNIDSRQIYIDMDIGTAKPTAVQQSQVNHFLIDVCLPSKPINLHDFQSIAQTSIERDLEKKGLTLLVGGSGLYLQALIGGLNPPAVPPQKFLRDQLKKIDKTELHKLLKLCDPFSAQRIHPEDSIRIIRALEVFYATGKMFSKEKNMTPIPWRVLELGVNPENLISRIQRRTEEMYKKGLIEETEDLINKYGKNLQLLKTIGYGEARSMINGKINYEEALEITIKRTCQLAKRQKTWFRNKHHSKWLNNENALPEALTSIYEFLG

SEQ ID NO: 177 - DNA, 900 bp, Prochlorococcus marinus
atgcaacccaataaacctcttgtcgtagcccttatgggcccaactgcaagtggtaaaactgaacttgcgattgatattgcaaaaaaaatcaattctaatattcacaatattgattctcgccaaatttatattgatatggatattggcaccgcaaagccaacagcagttcaacaaagccaagtaaaccatttccttattgatatttgcttgccatctaaaccaatcaatcttcatgattttcaatccatagccaaaacatccattgagagagatttagaaaaaaagggtttaactttacttgtaggaggaagtggtttatatctgcaagccttaattggaggacttaatcctccagcggtacctcctcaaaaattcttaagagatcaacttaaaaaaatcgataaagccgaacgacacaaattattaaagctttgtgaccctttctcagcgcagagaatacatccagaagactcaataagaataattcgtgctcttgaagttttttatgcaacaggaagaatgttttcgaaggctaaaaacatgaggcctactccttggagagttttggaacttggattaaatcctgaaaatttaaccagtagaattcaacttagaactagagaaatgtataaaaaagggttagtagaagaaacaggagatttgatcaataaatacggaaataatttacagttgcttaaaactattggatatggtgaagcaaggtctatgattaatggaaagattaattatgaggaggctttagaaataacaataaaacgaacttgccaattagccaaaagacaaaaaacttggtttagaaataagcataattctaaatggctaaatgatgagaatgcattacccgaagctttagcttctatctatgagtttcttggttga

SEQ ID NO: 178 - protein, 299 aa, Prochlorococcus marinus
MQPNKPLVVALMGPTASGKTELAIDIAKKINSNIHNIDSRQIYIDMDIGTAKPTAVQQSQVNHFLIDICLPSKPINLHDFQSIAKTSIERDLEKKGLTLLVGGSGLYLQALIGGLNPPAVPPQKFLRDQLKKIDKAERHKLLKLCDPFSAQRIHPEDSIRIIRALEVFYATGRMFSKAKNMRPTPWRVLELGLNPENLTSRIQLRTREMYKKGLVEETGDLINKYGNNLQLLKTIGYGEARSMINGKINYEEALEITIKRTCQLAKRQKTWFRNKHNSKWLNDENALPEALASIYEFLG

SEQ ID NO: 179 - DNA, 1023 bp, Synechococcus sp.
atggatcaaaaccggtctccaaatgggcgcgactgtcgagaacctccctccccctcctcgactgcaaggccggggcttgtcgtcatcgctggccccacggccaccggcaagtcgcgccaggcgctgctgttggcccagcggctgggatcccccctgttgaacgccgactctcgtcaggtgtaccgggagttcgacatcggcactgccaagcccactcccgccgagcgggccctctggccccacgagttgattgactttgtggatccccgccacacctatacagtggccgagtttcagcaggcggcccaggcgcgcattgccgcagcccatcggcagggacagactcctattctggtggggggcacagggctctacattcagtcgatcacggcaggcttagggatcccggcagttcccccccagcctcagttgcgcgctcaactggagacgtggccgcccgagatccgctacgcctggctgcagcagttggatcctgtggcagcggggcagattcaccctcatgatgaagtgcgcaccctgcgggctttggagatcatctacaccactgggaagccggcttcctacctgcggcaggcccatcctcctgactaccccattttgctcttggggttgcactgcccaatgccccgtctggaacaacgcattgcccggcgcacagcagaaatgctggcggcaggctggattgaggaggtaaaaacgctgcggcagcgctacggcccagacctgcccctcttgcagaccttgggctatgcggagatcggcgcttacctggaagggcggatcccggcagccgagctgcagcctctgattgtgcggcgcacccgccagtttgccaagcggcagatgacctggtttcgggccatgccagggatccagtggctggactgcgaggccgaggatctgcccgaacagatctggaagcgggttacagcgtggatggcagctcagaccagcgccggaaccactcctgccgtcgccgcgcgtccgcccgccgatccgtaa

SEQ ID NO: 180 - protein, 340 aa, Synechococcus sp.
MDQNRSPNGRDCREPPSPSSTARPGLVVIAGPTATGKSRQALLLAQRLGSPLLNADSRQVYREFDIGTAKPTPAERALWPHELIDFVDPRHTYTVAEFQQAAQARIAAAHRQGQTPILVGGTGLYIQSITAGLGIPAVPPQPQLRAQLETWPPEIRYAWLQQLDPVAAGQIHPHDEVRTLRALEIIYTTGKPASYLRQAHPPDYPILLLGLHCPMPRLEQRIARRTAEMLAAGWIEEVKTLRQRYGPDLPLLQTLGYAEIGAYLEGRIPAAELQPLIVRRTRQFAKRQMTWFRAMPGIQWLDCEAEDLPEQIWKRVTAWMAAQTSAGTTPAVAARPPADP

SEQ ID NO: 181 - DNA, 891 bp, Synechocystis sp.
atgaccccattaatggtgctggttttgggcccaaccgccagcggcaagaccagccttggcattgccctggcccaacagctcgattgccgggttctctcgattgattcgcgccagctctatgcaggcatggacatcggcacggccaaacccacgcgcgacgagcagcagcaggcccgccacgagctgttgaacctgagcacgcccgatcagcccatcaacctgcagcagttctgctcccatgcccagacgctgattgagcaagagcaacagcgggggcggcccgcgttgctggtgggcggcagcgggctgtatttgcaagccttgagccaagggctgcagccccccgccctaccgccacaaacggggctgcgtcagcaactgcagcaactggggcagtcctgttgtcatcagctgctgagccaggcggaccctcaagccgcagccaagatcgagcccaacgatccagtccgcacacagcgggcactggaggtgctctacggaaccggtcaaaccatctcaagccaacaggggcgctgcccgccggcctgccgggtgctggaactggggctcaaccccagcgacctcaaagagcgcattgagcagcgcacagcctccctctacgccaggggcctcgtggccgaaaccgaaacgctcagcaggcgctacggagctgatctgccccttctgcagaccattggttacggcgaagccctggcggtactcgccggcaggctcagcgagtccgaagcgcaagcactcaccagccggcgcacctggctgtttgccaaacgccaacgcacctggttccgcaaccgccatcagcccctttggctaaacacggaatccgcacttgaagaagcattggaagccattgcagcggccaggtcttag

SEQ ID NO: 182 - protein, 296 aa, Synechocystis sp.
MTPLMVLVLGPTASGKTSLGIALAQQLDCRVLSIDSRQLYAGMDIGTAKPTRDEQQQARHELLNLSTPDQPINLQQFCSHAQTLIEQEQQRGRPALLVGGSGLYLQALSQGLQPPALPPQTGLRQQLQQLGQSCCHQLLSQADPQAAAKIEPNDPVRTQRALEVLYGTGQTISSQQGRCPPACRVLELGLNPSDLKERIEQRTASLYARGLVAETETLSRRYGADLPLLQTIGYGEALAVLAGRLSESEAQALTSRRTWLFAKRQRTWFRNRHQPLWLNTESALEEALEAIAAARS

SEQ ID NO: 183 - DNA, 912 bp, Synechocystis sp.
atggccaaagttccgcccctgattgttatttgtggcaccaccgccagtgggaaatcccaactagcccttgatctagcccagcggttaaacgcagttattttgggggccgattccaggcaaatttataaagaattggacattggcaccgctaaacccacccttggcgatcgccaaacggtaccccattatctgattgacatttgtgaaccaacggaaaacttcaccctagcggaataccaacggcaagcccaggagttgattgcgtcattaaaccaaccgattctgctggtaggcggcactggtttatacatccaggcgatcgtcaaggggttaaaaattcctgctgttccaccccagaccaatttacgtgaacagttagctaacctcggccaacccttttgttatcaacttttaagtcaagtggaccccgtagcccaaagcaaaattgaacccgctgacgtggtgcggaccctgcgggctttggaagttttctatgccactgggcgacccatttccagcctacaaggggaaaatccccccagttatcccattgtgcaaatcggtttaggtctggaaccggagcaactccaacccagaattgttcaccgtacccatgccatggttgaggcggggttagtgaaggaagttgagggtttaatcaatcagtatggggaagacctacccctgctccatacccttggttacgctgagattaaacaatatctccaaggtcaaatatcgttaactcaagcgacggagtccatcattgtccacaccaggcaatttgccaaacgtcagcgcacttggttccgcaaagattcggcaatccactggtttgatgctaaccagccaaacctattagattcggtgacaaagttagtacaagttgacgtaaacgaaggaatgttttaa

SEQ ID NO: 184 - protein, 303 aa, Synechocystis sp.
MAKVPPLIVICGTTASGKSQLALDLAQRLNAVILGADSRQIYKELDIGTAKPTLGDRQTVPHYLIDICEPTENFTLAEYQRQAQELIASLNQPILLVGGTGLYIQAIVKGLKIPAVPPQTNLREQLANLGQPFCYQLLSQVDPVAQSKIEPADVVRTLRALEVFYATGRPISSLQGENPPSYPIVQIGLGLEPEQLQPRIVHRTHAMVEAGLVKEVEGLINQYGEDLPLLHTLGYAEIKQYLQGQISLTQATESIIVHTRQFAKRQRTWFRKDSAIHWFDANQPNLLDSVTKLVQVDVNEGMF

SEQ ID NO: 185 - DNA, 933 bp, Synechococcus sp.
atgcctcacaccagccccgaaacggaggcccaacgcgacagcaacgcccccctcgtggtggtgctgctcggacccaccgccagcggcaaaaccgccctcgcgctggagctggccgagcgcttcgacctggagatcatcaatgtggattcccggcagctgtaccaggagatgagcgtaggcacggccaagcccagcccggagcaacaggcccgcatccgccaccatctgctcgacctgcgcccccccgaccaaccgatcaccttgcaggaattccaggaggaagccctccaggcggtgaatcagagcctggccaaacgcggcgccgcctttctcgtgggcggcagcgggctctatctcaaggccctcacagctggtctgcgcccccccgctgtggcgccccaaccggcgctgcgccggcaactggcgcagctgggccaaccgctgtgccaccagctgctcaacactgccgatcccgaggcagccgtgcgcatcgccagcgcagatgcgctgcgcacccaacgcgccctggaggtgttgtacgccacaggcgcaccgatgagccgccaaaccagtgccagtccgccgccctggcgcgtgctggagctgggcctcaatccgctcgacctgcgccagcgcatcagtgcacgcacccaggcgctgtacagccaagggctggtggaggaaacccgccagctgcgcgagcgctacggccccgagctgccgctcctgcaaaccattggctacggcgaagcgttgcaagtgctcgcaggcgatctcagccgtcccgctgcgatcgcccacaccacccggcgcacccagcaattcgccaaacggcagcgcacctggttccggcggcagcaccagccgcactggctgcccgatgacaatcccctgaatgaagccggacgcctgatcgaagcgggtctaggctga

SEQ ID NO: 186 - protein, 310 aa, Synechococcus sp.
MPHTSPETEAQRDSNAPLVVVLLGPTASGKTALALELAERFDLEIINVDSRQLYQEMSVGTAKPSPEQQARIRHHLLDLRPPDQPITLQEFQEEALQAVNQSLAKRGAAFLVGGSGLYLKALTAGLRPPAVAPQPALRRQLAQLGQPLCHQLLNTADPEAAVRIASADALRTQRALEVLYATGAPMSRQTSASPPPWRVLELGLNPLDLRQRISARTQALYSQGLVEETRQLRERYGPELPLLQTIGYGEALQVLAGDLSRPAAIAHTTRRTQQFAKRQRTWFRRQHQPHWLPDDNPLNEAGRLIEAGLG

SEQ ID NO: 187 - DNA, 900 bp, Synechococcus sp.
ttgacgcagccagaacccttggtgatcacgttgctggggcccaccgccagcggcaaaacagccctgtcgctggagatcgctgaacggctcaatctgccggtgatcaacgtggattccaggcagctgtaccgggagatgaccgtgggcaccgccaaaccgacggcggagcaacgggcgcgggtgccacaccatttgctggatctacgcaaccccgatcagccgatcaccctgcaggaatttcaggcggaggccgagccctgcatccagcgtgagctgcaaagcaggggcatggcactgctggtggggggtagtggcttgtatctcaaggccctcaccagtggcctcaaaccaccggcggtgccaccgcaggcgcagctgcgtgagcagctgagccaattgggtcaagcgatctgccatccgctgctccagcaggccgatccaacggccggcgccaagatcgcccccgctgatgccgtacgcacccaacgggctctggaggtgctgtacgccaccggtcgaccgatgagcagccaggccacagctacaccaccgccctggcgggttttggaactggggctagatcctgccaacctgcgccagcgcattcagcagcgcaccgaccagctctacagcgacgggttggtggaggagacccggcaactttcggagcgctacggcgctgatctgccattgctgcagaccattggctacggcgaggccctgcagctcctcgaaggaacgatgaaccaggcgaaagccaaccgaatcaccacccagcgcacgcggcaattcgccaagcgtcagcgcacctggttccggcgccagcaccagccccattggctggcgccggctacagaacttgatcaggcgatgacgttgatcgagcagcatctaaggtga

SEQ ID NO: 188 - protein, 299 aa, Synechococcus sp.
MTQPEPLVITLLGPTASGKTALSLEIAERLNLPVINVDSRQLYREMTVGTAKPTAEQRARVPHHLLDLRNPDQPITLQEFQAEAEPCIQRELQSRGMALLVGGSGLYLKALTSGLKPPAVPPQAQLREQLSQLGQAICHPLLQQADPTAGAKIAPADAVRTQRALEVLYATGRPMSSQATATPPPWRVLELGLDPANLRQRIQQRTDQLYSDGLVEETRQLSERYGADLPLLQTIGYGEALQLLEGTMNQAKANRITTQRTRQFAKRQRTWFRRQHQPHWLAPATELDQAMTLIEQHLR

SEQ ID NO: 189 - DNA, 933 bp, Synechococcus sp.
atgaatcagatcaactctgaatttggccccgatgccggtgcaaaggcacccctcgttgtggcgctcgttgggccaacggcgagcggcaaaaccgcgctcgcgcttgagcttgctgagcacttccaactggagatcctcaacatcgattctcgccagctttaccgagagatggatatcggcacggccaaacccacagccgagcaacaacagcgcgtcacccatcacctcctcgacctgcgctcccctgatcaaccgatcacgcttcaggaatttcagcaagaagccactgcggccgtgagccaggttctcaaagagcgaggcgttgcttttttagctggaggcagcggcttgtacctcaaggctctcacccaaggactgcagcctccagccgtgcctcctcaagccgagcttcgccgccagctgagctcactcggtcaagcgaactgccaccagctcctccaacaggccgatccccaagcagccgccaagatcgcccctgccgatgcggttcgcacccaacgtgctctggaggtgctgtactccagcggcaaaccgatgagcgcgcaacagtcgaccaatcccccgccctggcgcgtactggagctcggactcaatcccatggagctgcgctcacgcatcgcccaacggactctccagatttatcaggaaggcttgcttgaagaaacgcggcagctgagccagcgctatgggcctgacctccccatgctgcaaacgatcggctacggcgaagcactagaggtgctgcaaggaggcctaagcgaagctcaggctatcgctaccaccacccgccgcacccagcagtttgccaagcgtcaacgcacctggttccgccgccaacacagtccccactggctcacaggtcaggatgccctcagcgaagcgatacgtctgatcgaagcgggtctaggctga

SEQ ID NO: 190 - protein, 310 aa, Synechococcus sp.
MNQINSEFGPDAGAKAPLVVALVGPTASGKTALALELAEHFQLEILNIDSRQLYREMDIGTAKPTAEQQQRVTHHLLDLRSPDQPITLQEFQQEATAAVSQVLKERGVAFLAGGSGLYLKALTQGLQPPAVPPQAELRRQLSSLGQANCHQLLQQADPQAAAKIAPADAVRTQRALEVLYSSGKPMSAQQSTNPPPWRVLELGLNPMELRSRIAQRTLQIYQEGLLEETRQLSQRYGPDLPMLQTIGYGEALEVLQGGLSEAQAIATTTRRTQQFAKRQRTWFRRQHSPHWLTGQDALSEAIRLIEAGLG

SEQ ID NO: 191 - DNA, 900 bp, Synechococcus sp.
ttgaacagctccaaccccctggtgatcaccctgctcgggcccaccgccagcggcaagaccgccctggcgttggacatcgccgaacggctggatctgccggtgttcaacgtggattcccgccagctctacagggagatggacatcggaaccgctaagccgacggcggagcaacaggcgcggataccgcaccatctgctggacctgcgcacgcccgatcagccgatcacgctgcaggaatttcaggcgatcgccaccccctgcatcaacgctgctctagagcagcgggacgtggcgctgctggtgggcggcagcggcctctatctcaaggccctcaccagcggtcttcagcctcctgccgtggcaccccagccgcaactgcgccagcagctgacggccctgggccagcagatctgccatcccctgctgcaggccgccgaccccaaggccgctgccaaaatcgcccctgccgatgccgtgcgcacccaacgcgcccttgaggtgctctacggctccgggcaaccgatgagccggcaggccacagccgcccctccgccctggcgggtgctggaactgggcctcaaccccgccaacctgcgccaacgcatccagcaacgtaccgagcagctctaccgcgatgggctggtggacgagacccagcgcctgagcgagcgctacggcgctgatctgccattgctgcagaccatcggctacagcgaagcgctgcagatgattggcggcagcctgaccacaacagaagcggtgcgaatcaccagccaacgcacccgccagttcgccaaacgccaacgcacctggttccggcgtcagcacaacccccactggctgcccgaccaggcaacgctgacggatgcgatgacgttgatcgaacaacatctaaggtga

SEQ ID NO: 192 - protein, 299 aa, Synechococcus sp.
MNSSNPLVITLLGPTASGKTALALDIAERLDLPVFNVDSRQLYREMDIGTAKPTAEQQARIPHHLLDLRTPDQPITLQEFQAIATPCINAALEQRDVALLVGGSGLYLKALTSGLQPPAVAPQPQLRQQLTALGQQICHPLLQAADPKAAAKIAPADAVRTQRALEVLYGSGQPMSRQATAAPPPWRVLELGLNPANLRQRIQQRTEQLYRDGLVDETQRLSERYGADLPLLQTIGYSEALQMIGGSLTTTEAVRITSQRTRQFAKRQRTWFRRQHNPHWLPDQATLTDAMTLIEQHLR

SEQ ID NO: 193 - DNA, 897 bp, Synechococcus sp.
atgtccacacaacctctcgtgatcaccttgctggggcccaccgccagcggcaaaaccgccctcgcccttgagctggccgaacggctcgggctgccagtgatcaacgtggattcccgccagctgtatcgggagatggacgtgggcaccgccaaacccacagccgaacaacaggcccgggtgacgcaccacttactcgacctgcgcgatcccaaccagccgatcacgctgcaggagtttcaagcggaagccacgccctgcattgagcgtgaactaagcgaacggggcatcgctctacttgtggggggcagcggtttgtacctgaaagccttaacaagcggtctcaaaccaccagctgtgggcccgcaaccagagctgcgtaagcaattcagtgccatgggacaagccgtctgccatccgctcttggccgccgcggatccaatagccgctgcaaaaatttcccctgcggatgtggtccgcacccagcgcgcccttgaggtgctctacgcctcaggccaaccgatgagtggtcaggccagcgtggaacctcccccctggagaattttggaactcggcctaaatcccaccaacctgcgccaacgcatcaaccaacgcactgaacagctgtatcaagacggattagtggaggaaacccaacgcttggccgaccgctacggagccgacttaccgctgctgcaaacgatcggctacggagaagcactgcaaatcaacgatggatcgatcacaaggcaggcggcgatcgccaccacctgccagcgcacacggcaattcgccaaacgtcaacgcacctggtttcggcgccaacacactccccaatggctcagtgaacaggatctgttaacggaagcgatgacgctgatcgaacaacacctaggctga

SEQ ID NO: 194 - protein, 298 aa, Synechococcus sp.
MSTQPLVITLLGPTASGKTALALELAERLGLPVINVDSRQLYREMDVGTAKPTAEQQARVTHHLLDLRDPNQPITLQEFQAEATPCIERELSERGIALLVGGSGLYLKALTSGLKPPAVGPQPELRKQFSAMGQAVCHPLLAAADPIAAAKISPADVVRTQRALEVLYASGQPMSGQASVEPPPWRILELGLNPTNLRQRINQRTEQLYQDGLVEETQRLADRYGADLPLLQTIGYGEALQINDGSITRQAAIATTCQRTRQFAKRQRTWFRRQHTPQWLSEQDLLTEAMTLIEQHLG

SEQ ID NO: 195 - DNA, 939 bp, Thermosynechococcus elongatus
gtgggggatgcagggctaattgttattgggggggcaacggctacaggcaaaacggcgctagcgatcgcccttgcccaacaattgaatagtgtcattttgagtgccgactcccgccaagtctaccgcggctttgatattggcacagccaagcccactccagcccagcaacagcaggtgcgccatcacctcatcgatatttgtgacccccgcgagacgctgaccctagcaatttaccaagccaaggctcaagccctgattgcccactaccacgcccaagggatcacgcccctcttggtgggggggacaggattgtatatccgcagcattacccaagggctaacaatgccccaagtcccaccgcaaccccatctacgggctcaattgatggctctgggtcagcaggaatgctatcagtggcttcagcaggtggatcctgtggcggcgcaacggatccatgcccacgatcaagtgcgtaccctgcgagccttggaggtctattacaccactggggtgcccctcagccagcagcaacggcgcgaaccgcctccctaccggatttggtactttgccctcacggggggcgatcgccagcaagagcgctgccgtattgaagcccgcactcaggagatgctagccatgggctggctcgatgaaattcagcaactgcaaaggcagtacggcgaggatttgcccctcctagacaccttgggctatcgggaaatgcgccaatatctgcggggagaagtcaccctcgcggaggctattgccctcacagtgcagcacacccaacaatttgccaaacggcagcggacatggttccgggcagaacctgacatccattggctgcaagccaccaccctagaggcgcaactggcagagattcaagcacaattcactctctgtcccaagaccactgcaacaaagcggcggatgagctga

SEQ ID NO: 196 - protein, 312 aa, Thermosynechococcus elongatus
MGDAGLIVIGGATATGKTALAIALAQQLNSVILSADSRQVYRGFDIGTAKPTPAQQQQVRHHLIDICDPRETLTLAIYQAKAQALIAHYHAQGITPLLVGGTGLYIRSITQGLTMPQVPPQPHLRAQLMALGQQECYQWLQQVDPVAAQRIHAHDQVRTLRALEVYYTTGVPLSQQQRREPPPYRIWYFALTGGDRQQERCRIEARTQEMLAMGWLDEIQQLQRQYGEDLPLLDTLGYREMRQYLRGEVTLAEAIALTVQHTQQFAKRQRTWFRAEPDIHWLQATTLEAQLAEIQAQFTLCPKTTATKRRMS

SEQ ID NO: 197 - DNA, 930 bp, Trichodesmium erythraeum
ttgactttaattactatttgcggtccaactgctacaggtaagtctggattggccttagatttggcccataggttgggttcaataattctgagtgcagactcccgtcagatatataaatattttaacattggaacggcaaaaccaactataaaagaacaacagttagtatctcattatttaatagatatctgtgaacctacagagattttgactttagcagaataccagaaacaggcgcaaagctttattcagtctcctggttctcaaactgatgtggtattgccaacattattggtggggggtactggtttatacattaaggcaatagttaagggtttgaaaattcctagggtggggcctaatgaaaagttgcgatcgcaattagcaaatttaggtcaaaaacaatgttacaaaatgttgcagcaggttgatcaggttgccgttgagaaaattcacccgaatgatgtggtccgaactttacgagcattggaggtattttatgtgagtgggaaaccaatttctcaacagcagggagaagaccttccaaattatccaattttgcaaatagggttagactgtgatgtagaagttttgggggaacgtattcgtgatcggactgagaaaatggtggaagttgggttagtggaggaagtcaagtgtttgtgtgaaaaatatggtgagaagttgcctttattaaatactttaggttatgcagaaatgaaacaatatttggcgggagatatttccttggctgaagcgatcaaagcaacagttttacatactcgtcagtttgccaagcgacaacgcacttggtttcgaggatatccagaaattgaatggtttgatgggaatgccccaaatttattggacaaggtttgggagcgggtgagggagtttactagaatactggcagaaaagacacaggagtga

SEQ ID NO: 198 - protein, 309 aa, Trichodesmium erythraeum
MTLITICGPTATGKSGLALDLAHRLGSIILSADSRQIYKYFNIGTAKPTIKEQQLVSHYLIDICEPTEILTLAEYQKQAQSFIQSPGSQTDVVLPTLLVGGTGLYIKAIVKGLKIPRVGPNEKLRSQLANLGQKQCYKMLQQVDQVAVEKIHPNDVVRTLRALEVFYVSGKPISQQQGEDLPNYPILQIGLDCDVEVLGERIRDRTEKMVEVGLVEEVKCLCEKYGEKLPLLNTLGYAEMKQYLAGDISLAEAIKATVLHTRQFAKRQRTWFRGYPEIEWFDGNAPNLLDKVWERVREFTRILAEKTQE

SEQ ID NO: 199 - protein, 8 aa, Artificial sequence
  ATP/GTP-binding motif A
  VARIANT (2)..(2): Xaa can be Pro or Ala or Thr
  VARIANT (5)..(5): Xaa can be Ala or Thr or Ser
  VARIANT (8)..(8): Xaa can be Ser or Thr
GXTAXGKX

SEQ ID NO: 200 - protein, 5 aa, Artificial sequence
  conserved motif I of IPPT polypeptides
  VARIANT (4)..(4): Xaa can be Gln or Leu
  VARIANT (5)..(5): Xaa can be Val or Leu or Ile
DSRXX

SEQ ID NO: 201 - protein, 8 aa, Artificial sequence
  conserved motif II of IPPT polypeptides
  VARIANT (1)..(1): Xaa can be Asn or Asp or Ser or Thr
  VARIANT (2)..(2): Xaa can be Ile or Val
  VARIANT (8)..(8): Xaa can be Thr or Ser
XXGTAKPX

SEQ ID NO: 202 - protein, 8 aa, Artificial sequence
  conserved motif III of IPPT polypeptides
  VARIANT (2)..(2): Xaa can be Val or Ala or Ile
  VARIANT (5)..(5): Xaa can be Ser or Thr
LXGGXGLY

SEQ ID NO: 203 - protein, 10 aa, Artificial sequence
  conserved motif IV of IPPT polypeptides
  VARIANT (1)..(1): Xaa can be Phe or Tyr or Leu
  VARIANT (4)..(4): Xaa can be Arg or Lys or Gln
  VARIANT (6)..(6): Xaa can be Arg or Lys or Met
XAKXQXTWFR

SEQ ID NO: 204 - DNA, 1553 bp, Oryza sativa
gtcaccaccgtcatgtacgaggctgctccaccactgcctcactcgccaccagcgtctcccgccgcgtgcaatacaagaagaaacatcgaacggtcatataaggtaagacccactaccgatttaacctatccttcccacaatctaatccactcatttctcctcccacgatcttattctctcatttctcctcactatttttgcatttgtaggaaacacaatgacaccgtcgaagaaagctggtggagcaccgtagccagcaatcaccaaaacacagaggggaggaggtcggcagcggccatgcggacggcgacgagacaacgtgacgcaaagagggaggaggacgttggcgatcatgctggtgttggcggaggaggtcactggccacgcggatgacagcggggcagcgcaacacaaaaaggggggaggatgccggcgaccacgctagtgaccatgaagcaagatgatgtgaaagggaggaccggacgagggttggacctctgccgctgacatgaagagcgtgatgtgtagaaggagatgttagaccagatgccgacgcaactagccctgcaaggtcacccgactgatatcgctgcttgcccttgtcctcatgtacacaatcagcttgcttatctctccatactggtcgtttgtttcccgtggccgaaatagaagaagacagaggtaggttttgttagagaattttagtggtattgtagcctatttgtaattttgttgtactttattgtattaatcaataaaggtgtttcattctattttgactcaatgttgaatccattgatctcttggtgttgcactcagtatgttagaatattacattccgttgaaacaatcttggttaagggttggaacatttttatctgttcgtgaaacatccgtaatattttcgttgaaacaatttttatcgacagcaccgtccaacaatttacaccaatttggacgtgtgatacatagcagtccccaagtgaaactgaccaccagttgaaaggtatacaaagtgaacttattcatctaaaagaccgcagagatgggccgtggccgtggctgcgaaacgcagcgttcaggcccatgagcatttattttttaaaaaaatatttcacaacaaaaaagagaacggataaaatccatcgaaaaaaaaaactttcctacgcatcctctcctatctccatccacggcgagcactcatccaaaccgtccatccacgcgcacagtacacacacatagttatcgtctctccccccgatgagtcaccacccgtgtcttcgagaaacgcctcgcccgacaccgtacgtggcgccaccgccgcgcctgccgcctggacacgtccggctcctctccacgccgcgctggccaccgtccaccggctcccgcacacgtctccctgtctccctccacccatgccgtggcaatcgagctcatctcctcgcctcctccggcttataaatggcggccaccaccttcacctgcttgcacaccacagcaagagctaagtgagctagccactgatcagaagaacacctcgatctctgagagtg

SEQ ID NO: 205 - DNA, 1300 bp, Oryza sativa
ttcttctgaagctgaagccctgcgaaataggcctttaaacgctttaaggttactggatgatcatatcggcgtaagaccggtttaaacatggtttcgctttgtgaatccaatgtgagtcacgacgtgacacatggcacgtccttggagctttagacatatcgaatctgagcactggagtggccgagtgggtgagcggccaaatccgttttagacagatcgcactgacacgatgttgatcattgatactaataccattttatcaagcagtagtgttgaaaaaaaaacttatgttctcttcaactgtgagatttcatcccgtttcaagatgaacaagccatgcatgtgagatgtgaacagaaggcagaagacagtggaaagacaggacaaataagtgaagagggatcaaatcaatgggcctgacggtttctgaaagttgacatggaaatcgccggtgatcaccggtttatacgttatttaaatctgcgatttccactttcgtttgctttcggggttccgatttgagtcacgcacatattcttcatcgtgctttggatctcagcaccgtagtaacttttggacaaattgcattcgccgacactaataacatgttctctttatgctgctttacatatactgcttatccacacccaatcccatgttcatatattatgagatggagggagtaaactttgttaacagcaacattttttatattaaagcatcaactaattaaagcacaagatacgcatgttatctcaataaatcttccagtgcatgtataaagaagatgtcgccgctaacttagataatttttgtgacctttatcctggccggcataattaattcttccggaaattaaaagctagtttttccatattcatcagtacagacaagacagcatagtaagcgaagcatacctgacgtgttagctcattgtaactcgatctggaacactcgatgctagacacagacagacactcctcgtgatgaacgttagcatttagcaacatacggtgataaagcagctggggatcgatccatccatccatcgtctttacacgtacttaccttgctaaccgcactgtcgactcttgcatgtttgcatgtaatccaaatggaccccacgtggaacatgctcacagtgctttgcagctgctttccaaaatgctttctttcacttcttccattcctctgtccacaaaaaaagtagtgtgttcttgagcctatataagagagggtcacacgctccagtcgactcaccatcgatccatctgacggttagttccaagggaaagaagaa

SEQ ID NO: 206 - DNA, 55 bp, Artificial sequence
  primer: prm07646
ggggacaagtttgtacaaaaaagcaggcttaaacaatggaatcgcgtttgaaacc

SEQ ID NO: 207 - DNA, 50 bp, Artificial sequence
  primer: prm07645
ggggaccactttgtacaagaaagctgggttcaaacgccctcactctttcg

SEQ ID NO: 208 - DNA, 1727 bp, Arabidopsis thaliana
caatgcttttttataatgccaactttgtacaaaaaagcaggcttaaacaatggatactctctttagactagtctgtctccaacaacaacaacaatccgatagtatcattacaaatcaatcttcgttaagcagaacttccaccaccactactggctctccacaaactgcttgtcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatactagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaaagggttgtttttatttacccagctttcttgtacaaagttggcattataagaaagcattgcttatcaatttgttgcaacgaac

SEQ ID NO: 209 - protein, 531 aa, Arabidopsis thaliana
MDTLFRLVCLQQQQQSDSIITNQSSLSRTSTTTTGSPQTACHYNFPQNDVVEECFNFFMDEEDLSSSSSHHNHHNHNNPNTYYSPFTTPTQYHPATSSTPSSTAAAAALASPYSSSGHHNDPSAFSIPQTPPSFDFSANAKWADSVLLEAARAFSDKDTARAQQILWTLNELSSPYGDTEQKLASYFLQALFNRMTGSGERCYRTMVTAAATEKTCSFESTRKTVLKFQEVSPWATFGHVAANGAILEAVDGEAKIHIVDISSTFCTQWPTLLEALATRSDDTPHLRLTTVVVANKFVNDQTASHRMMKEIGNRMEKFARLMGVPFKFNIIHHVGDLSEFDLNELDVKPDEVLAINCVGAMHGIASRGSPRDAVISSFRRLRPRIVTVVEEEADLVGEEEGGFDDEFLRGFGECLRWFRVCFESWEESFPRTSNERLILERAAGRAIVDLVACEPSDSTERRETARKWSRRMRNSGFGAVGYSDEVADDVRALLRRYKEGVWSMVQCPDAAGIFLCWRDQPVVWASAWRPT

SEQ ID NO: 210 - DNA, 1596 bp, Arabidopsis thaliana
atggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaa

SEQ ID NO: 211 - protein, 531 aa, Arabidopsis thaliana
MDTLFRLVSLQQQQQSDSIITNQSSLSRTSTTTTGSPQTAYHYNFPQNDVVEECFNFFMDEEDLSSSSSHHNHHNHNNPNTYYSPFTTPTQYHPATSSTPSSTAAAAALASPYSSSGHHNDPSAFSIPQTPPSFDFSANAKWADSVLLEAARAFSDKDTARAQQILWTLNELSSPYGDTEQKLASYFLQALFNRMTGSGERCYRTMVTAAATEKTCSFESTRKTVLKFQEVSPWATFGHVAANGAILEAVDGEAKIHIVDISSTFCTQWPTLLEALATRSDDTPHLRLTTVVVANKFVNDQTASHRMMKEIGNRMEKFARLMGVPFKFNIIHHVGDLSEFDLNELDVKPDEVLAINCVGAMHGIASRGSPRDAVISSFRRLRPRIVTVVEEEADLVGEEEGGFDDEFLRGFGECLRWFRVCFESWEESFPRTSNERLMLERAAGRAIVDLVACEPSDSTERRETARKWSRRMRNSGFGAVGYSDEVADDVRALLRRYKEGVWSMVQCPDAAGIFLCWRDQPVVWASAWRPT

SEQ ID NO: 212 - DNA, 1509 bp, Pinus taeda
atggatagattgttcacctccagattagcagattatcaatccgaacaccctctgtcatgcttcaattctaacaaaaattgtgaagatgcagacacccctagacacatagacagctacaacaaccatctcagccagtttgttctcccatccagaagggataaatcaaggcaatgcaattctttcatggaggacgaagacttctcattcaagcaattccttcctttcaaagaaatgttcaacagcaatcagaccggaaagggtaccacgggacctaaccaatttagcggcactagggctacttctagcagatcaagtgaagtaccagaccccagcttgttttctgaactgaaccctaattttccagaggagtttggaccagcaggatcacgtcgatgggcttcaaatcttctgctagaatgtgccagagcaatagcagagaatgaaaaaagccgaacccaacatctgctatggatgctaaatgaactatcatctccctatggggattgtgagcagaaattggcctcgtacttcttgcaggcctttttttgcaaaataacagatactggtcctcgttgctacaccacactttgttcagctgctgaaaaaacatactcatttgattccacaagaaaaatgatcttgaaattccaggaatcaagcccatggacaacctttggtcatgttgctgccaatggagcaatcctggagtcctttgagggagaaatgaagctgcacatagttgacctgagcaacactttttgcacacagtggcctactttgttagaggccttggccaccagaagtgatgacacccctcatcttaggttgactactgtagtcaccagcaaggaagccacagcaatgaaggtcatgaaggaaatagggcaaagaatggagaaatttgcacggctcatgggggttccatttgaattcagtgttattcatcaacaacatctccacaagctcaacgttggtgcccttaaaatcagaccagatgaagctctggccatcaactgcatccacagcctgcaacgtgttatcaagaatggaagggattccatattgtccacgttctacagcatgaaccccaagatagttactgttgtagaggacgaagtagacctgactcatgaagattttggtgattgttttagtgaatgccttcgttttttttccttgttttttgattctctagaggagagcttctccagaaccagcaacgagagattaatgcttgaaagaaccagtgcaaggagcattgtgaacatattggcctgtgaggattctgaagtttatgagcgcagggaaaagggtgcacagtgggcttggaggctcaaggaggcaggatttatacatgctgcattcagtgatgatgttgttgatgatgttagggctcttctcaagagatacaaggagggttggggtcactgtagcaattcagatgggcttttcttgacctggaaggagcagtgcgccatttgggcttctgcctggaagccatgcttgtaa

SEQ ID NO: 213 - protein, 502 aa, Pinus taeda
MDRLFTSRLADYQSEHPLSCFNSNKNCEDADTPRHIDSYNNHLSQFVLPSRRDKSRQCNSFMEDEDFSFKQFLPFKEMFNSNQTGKGTTGPNQFSGTRATSSRSSEVPDPSLFSELNPNFPEEFGPAGSRRWASNLLLECARAIAENEKSRTQHLLWMLNELSSPYGDCEQKLASYFLQAFFCKITDTGPRCYTTLCSAAEKTYSFDSTRKMILKFQESSPWTTFGHVAANGAILESFEGEMKLHIVDLSNTFCTQWPTLLEALATRSDDTPHLRLTTVVTSKEATAMKVMKEIGQRMEKFARLMGVPFEFSVIHQQHLHKLNVGALKIRPDEALAINCIHSLQRVIKNGRDSILSTFYSMNPKIVTVVEDEVDLTHEDFGDCFSECLRFFSLFFDSLEESFSRTSNERLMLERTSARSIVNILACEDSEVYERREKGAQWAWRLKEAGFIHAAFSDDVVDDVRALLKRYKEGWGHCSNSDGLFLTWKEQCAIWASAWKPCL

SEQ ID NO: 214 - DNA, 1131 bp, Physcomitrella patens
tgggccaaagctcttcttctggactgtgcaagagctatagctgagaaagacacttcgcgcgttcaaagcattatgtggattttgaacgagagtgcatctccatacggagattccgaccaaagacttatgtcatatttcgtccaagcacttgtctgcaagatcacagacacgggctctcgatgccaccgaagtctaacttccgccgccgaaaagacgtattcctttgaatcgatgcgaaatatgatccttaactttcagcagaatgcgagcccctggacaacttttgggcatgttgctgcaaacggagctcttctggagacgatggaaggggagtccaagatacatatcattgacatcagcagtacattgtgtacgcaatggccaacctttctggaagctctagcaacgcggacggatataacccctcacctccgcctcacatgcatcgtgatatcacccgaagaagcagcgttgagggtgatgaaacaagtcatgaacagaatagacaggtttgccagactgatgggagtgccgttcgagagcacggtgatccataaacctcacttggaaacgttggatctggatgagctgaacttgcgggaaggtgaagctctcgctgtgaattgcgttcagactctacaccacatctccgagtgtgtagcagccgaggagcagtacagtcctcgagaccgaattctgtccactttccggagtgccaaacccaagattctgtcgatcgtggaggatgaagctaacatgatctcaccagacttccttggttgcttccgggaggcccttagattttactcgctcttatttgaatctttggaggagagctttccccgagccagcaacgagcgtctcatgcttgagcgaaattgcgcccgcaagctggtgaatatgctaagttttgacgccacggagagtacagaaagacaagagaaagggattcattgggattaccgactacgaaaagtgggctttgagcccgtgtcattcagtcacgacgtggtggatgacgttcaagctctactcaagagatacaagaaggggtggggtcttgacatcaccgatgccaggctttaccttacctggaaggaacaagcagttatttgcagcaccacatggaag

SEQ ID NO: 215 - protein, 377 aa, Physcomitrella patens
WAKALLLDCARAIAEKDTSRVQSIMWILNESASPYGDSDQRLMSYFVQALVCKITDTGSRCHRSLTSAAEKTYSFESMRNMILNFQQNASPWTTFGHVAANGALLETMEGESKIHIIDISSTLCTQWPTFLEALATRTDITPHLRLTCIVISPEEAALRVMKQVMNRIDRFARLMGVPFESTVIHKPHLETLDLDELNLREGEALAVNCVQTLHHISECVAAEEQYSPRDRILSTFRSAKPKILSIVEDEANMISPDFLGCFREALRFYSLLFESLEESFPRASNERLMLERNCARKLVNMLSFDATESTERQEKGIHWDYRLRKVGFEPVSFSHDVVDDVQALLKRYKKGWGLDITDARLYLTWKEQAVICSTTWK

SEQ ID NO: 216 - DNA, 1116 bp, Physcomitrella patens
ctactggtagaatgtgcgagggcaatcactgcaaatgattccgctcgtgtgaagaacttgatgtgggtgttgaatgagctgggctctccgtacggagacgctgaccaaagagtagctgcatatttcctgcaggctttgttttgtaagatcaccaatacgggatctagctgctaccgcgcactcactgctgctgcggagaggacctattcgttcgatacattacgaaaaatgattctcgactaccaggaggcaagtccgtggacaactttcggtcatacagctggaaacggagctatgatggaggcctttgaaggtgagacaaaaattcacattgtggacatgagcagcacctattgcacccaatggccgatccttttcgaagctctagcaacacgagctgagggtacacctcacctacgcctgagcaccatcgtcatatcccccgaggagtctgccttacaggtgatgaagcagattatgaccaggttggaaagatttgctagacttatgggtgttccatttgagtacgttgtaaagcatgaaccacaactggagaaattggaacttgcagcgctggacctgcggcaggacgaagtcctcgccatcacgtgcaatcacactcttcatcacgtgtcggagattgtgccacgaggagagcagtacagtccgcgcgatgtgctcctgtgcaccttccgaaacgcaaatccgaagattatgatccttgtggaggaagaagtggatctgacttcgccagattttattgtttgtttctgtgaggcgctcaagttttattccctcttgtttgaatccctggaggagaacttccccagaactagcaacgaacgtttaatcctggagcggatttgtgcacggaacctggtcaatctgataggttgtgaccctccagagaacgttgagaggcaggagacgggaatccagtgggatctccgtttgaaaagaataggcttcgtgccctgccccttcagcgacgatgttgttgacgacgttcgtgcgctcctcaagaggtacaaagagggatggagcctgagcatgaacgagaacagactttacctagcgtggaaagagcaggtggttctatgcgccactgcttggaag

SEQ ID NO: 217 - protein, 372 aa, Physcomitrella patens
LLVECARAITANDSARVKNLMWVLNELGSPYGDADQRVAAYFLQALFCKITNTGSSCYRALTAAAERTYSFDTLRKMILDYQEASPWTTFGHTAGNGAMMEAFEGETKIHIVDMSSTYCTQWPILFEALATRAEGTPHLRLSTIVISPEESALQVMKQIMTRLERFARLMGVPFEYVVKHEPQLEKLELAALDLRQDEVLAITCNHTLHHVSEIVPRGEQYSPRDVLLCTFRNANPKIMILVEEEVDLTSPDFIVCFCEALKFYSLLFESLEENFPRTSNERLILERICARNLVNLIGCDPPENVERQETGIQWDLRLKRIGFVPCPFSDDVVDDVRALLKRYKEGWSLSMNENRLYLAWKEQVVLCATAWK

SEQ ID NO: 218 - DNA, 1812 bp, Oryza sativa
atggataccctcttcaggttggttagcctccaccaccatcaccaccaccagcacgcggcctcaccgtcgccgccggaccagccgcacaagtcgtacccctcctcgcgagggagcaccagctccccctcctcccaccacacccacaaccacacctactaccaccactcccactcccactacaacaataatagcaacaccaactactattaccagggtggtggaggcggcggcggagggtactactacgcggaggagcagcagccggcggcgtacctagaagaatgcggcaacggccaccagttttacatggatgaagacttctcctcctcgtcttcctcccgccagttccactcgggaacgggcgcgccgtcgtcggcgccggtgcctcctcctccgtcggcgacgacgtcgtccgcgggcgggcacgggctgtttgaggcggcggacttctcgttcccgcaggttgatatcagcctcgacttcggcggctctccggccgttccgtcgtcgtccggtgctggcgccggcgccggggcagcgccgtcgtcgtcggggaggtgggcggcgcagctgctgatggagtgcgcgcgcgcggtggcggggcgcgacagccagcgcgtgcagcagctcatgtggatgctcaacgagctggcctcgccgtacggcgacgtcgaccagaagctggcctcctacttcctgcagggcctcttcgcgcggctcaccacctccggcccgcgcacgctgcggacgctcgccaccgcgtcggaccggaacgcgtcgttcgactccacgcgccgcacggcgctcaagttccaggagctcagcccgtggacgccgttcgggcacgtcgccgccaacggcgccatactcgagtcgttcctggaggccgcggcggcgggcgccgccgcctcctcctcctcgtcgtcttcatcgtcgacgccgccgacgcggctgcacatcctcgacctgagcaacacgttctgcacgcagtggccgaccctcctggaggcgctggccacccggtcctcggacgacacgccgcacctgtccatcaccaccgtcgtgcccacggcggcgccgtcggcggccgcgcagcgcgtgatgcgggagatcgggcagcgcctcgagaagttcgcgcggctgatgggcgtcccgttcagcttccgcgccgtgcaccactcgggggacctggccgacctcgacctcgccgcgctggacctccgcgagggcggcgccaccgccgcgctcgccgtcaactgcgtaaacgcgctgcgcggggtcgcgcgggggcgcgacgcgttcgtggcgtcgctccggcgcctggagccgcgcgtggtcaccgtcgtggaggaggaggccgacctggcggcgccggaggcggacgcgtcgtcggaggccgacaccgacgccgcgttcgtcaaggtgttcggcgagggcctccgcttcttctcggcgtacatggactcgctggaggagagcttccccaagacaagcaacgagaggctgtcactggagagggcggtcggccgtgccatcgtcgacctcgtgtcatgcccggcctcccagtccgccgagcgccgggagaccgccgcgtcgtgggcgcggcgcatgcggtcggcggggttctcgccggcggcattcagcgaggacgtcgccgacgacgtgcggtcgcttctccggcggtacaaggagggctggtcgatgcgggacgccggcggtgccacggacgacgccgccggcgccgctgctgccggagcgttccttgcgtggaaggagcagcctgtcgtgtgggcgagcgcgtggaagccatga

SEQ ID NO: 219 - protein, 603 aa, Oryza sativa
MDTLFRLVSLHHHHHHQHAASPSPPDQPHKSYPSSRGSTSSPSSHHTHNHTYYHHSHSHYNNNSNTNYYYQGGGGGGGGYYYAEEQQPAAYLEECGNGHQFYMDEDFSSSSSSRQFHSGTGAPSSAPVPPPPSATTSSAGGHGLFEAADFSFPQVDISLDFGGSPAVPSSSGAGAGAGAAPSSSGRWAAQLLMECARAVAGRDSQRVQQLMWMLNELASPYGDVDQKLASYFLQGLFARLTTSGPRTLRTLATASDRNASFDSTRRTALKFQELSPWTPFGHVAANGAILESFLEAAAAGAAASSSSSSSSSTPPTRLHILDLSNTFCTQWPTLLEALATRSSDDTPHLSITTVVPTAAPSAAAQRVMREIGQRLEKFARLMGVPFSFRAVHHSGDLADLDLAALDLREGGATAALAVNCVNALRGVARGRDAFVASLRRLEPRVVTVVEEEADLAAPEADASSEADTDAAFVKVFGEGLRFFSAYMDSLEESFPKTSNERLSLERAVGRAIVDLVSCPASQSAERRETAASWARRMRSAGFSPAAFSEDVADDVRSLLRRYKEGWSMRDAGGATDDAAGAAAAGAFLAWKEQPVVWASAWKP

SEQ ID NO: 220 - DNA, 1809 bp, Oryza sativa
atggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgtcctacagctactaccaccacagcagcaacagcggcggcggcggcggaggcggcggagggtactactacggcggccagcagccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcgtccacgcccacggggacggcgccgacgccgccgctgtcgacctcgtccaccgcggcgggcgccgggcacggcctgttcgaggcggcggacctgtcgttcccgccggacctcaacctcgacttctcgtccccggcgtcgtcgtccggcggcgggacagcgtcgtcgggcgcggttgggggcggcggcggcgggaggtgggctagccagctgctgctggagtgcgcgcggtcggtggccgcccgcgacagccagcgcgtgcagcagctcatgtggatgctcaacgagctcgcgtcgccgtacggcgacgtggagcagaagctggcttcctacttcttgcaggggctgttcgctcggctcacggcgtccgggccgcgcacgctgcgcacgctcgccgcggcgtccgaccggaacacgtcgttcgactcgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggagaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccgacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcgggagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatga

SEQ ID NO: 221 - protein, 602 aa, Oryza sativa
MDTLFRLVSLQAASEQQQQQQQSASYNSRSTTSSGSRSSSHQTNASYSYYHHSSNSGGGGGGGGGYYYGGQQPPPSQYYYLEPYQEECGNAPHHQLYMDEDFSSSSSSRHFHHGARVQQQQPPASSTPTGTAPTPPLSTSSTAAGAGHGLFEAADLSFPPDLNLDFSSPASSSGGGTASSGAVGGGGGGRWASQLLLECARSVAARDSQRVQQLMWMLNELASPYGDVEQKLASYFLQGLFARLTASGPRTLRTLAAASDRNTSFDSTRRTALRFQELSPWSSFGHVAANGAILESFLEVAAAASSETQRFHILDLSNTFCTQWPTLLEALATRSADETPHLSITTVVSAAPSAPTAAVQRVMREIGQRMEKFARLMGVPFRFRAVHHSGDLAELDLDALDLREGGATTALAVNCVNSLRGVVPGRARRRDAFAASLRRLDPRVVTVVEEEADLVASDPDASSATEEGGDTEAAFLKVFGEGLRFFSAYMDSLEESFPKTSNERLALERGAGRAIVDLVSCPASESMERRETAASWARRMRSAGFSPVAFSEDVADDVRSLLRRYREGWSMREAGTDDSAAGAGVFLAWKEQPLVWASAWRP

SEQ ID NO: 222 - DNA, 1785 bp, Zea mays
atggatacgctgtttaggttggttagccttcaagcctccgaacagcagcagcagcagcaatcggcgtcctacaactcgaggagcaccacgtcgagcggctccaggtcgtcgtcgcaccagaccaacgcatcctacaactactactaccacagcaacagcagcggcggcggcggcggcgggcagtactactacggtcagcagcacccacagcagcaccagcaccagcagtactacctggagccgtaccagcaagaagaatgcggcaacacccaccacctttacatggatgaagacttctcctcctcgtcctcgtcgaggcagcatttccactcgcacggcgcggtggtgcagccgccgacgtcgtccacggccacgcccacggcgccgacgccctcgctgtccacgtcgtccacggccgctggggcggcgcacgcgctgttcgaggcggccgacctgtcgttcccgcctgacctcaacctcgacttctcatccccggcctcgtcgtccggcgggggcgcggcctcgtcggcggcggtcgggggaggtggcgggggaaggtgggcgagccagctgctgctggagtgcgcgcgcgcggtggcgggccgcgacagccagcgcgtgcagcagctgatgtggatgctcaacgagctggcctcgccgtacggggacgtcgagcagaagctggcgtcctacttcctccaggggctcttcgcgcgcctcacggcgtccggaccgcggacgctgcgcacgctcgcggcggcgtccgaccggaacacgtccttcgactccacgcggcgcacggcgctgcggttccaggagctcagcccgtggtcgtcgtttgggcacgtggccgccaacggcgccatcctggagtcgttcctggaggccgccgcggcgtcgccggagccccagaggctccacatcctcgacctcagcaacacgttctgcacgcagtggcccacgctgctggaggcgctcgccacgcggtccgccgacgacacgccgcacctgtcgatcaccacggtggtctcctccgcgccgtccgcgccgacggccgccgtgcagcgcgtgatgcgggagatcgggcagcggatggaaaagttcgcgcggctgatgggcgtgcccttcagcttccgcgcagtgcaccacgccggggaccttgcggggctcgacctcgacgcgctcgacctgcgcgacggcggcgccaccaccgcgctcgccatcaactgcgtcaactcgctgcgcggcgtggtgccgggcggtgcgcggagacgggacgcgttcgccgcgtccctccggcgtctcgatccgcgggttgttactgtcgtcgaggaggaggccgatctcgtggcttttgaccccggcgcgcccgaggaaagcggcgacacggaggcagcgttcctgaaggtgttcggcgagggcttgcggttcttctcggcttacatggactcgctggaagagagcttccccaagactagcaacgagaggctggcgctggagaggggagccggacgtgccattgtagacttggtctcgtgcccggcgtcggagtccatggagcggcgggagacggcggcttcatgggcgcgccgcatgcggtcttccggcttctctccggtggcgttcagcgaggacgtcgccgacgacgtgcggtcgttgctccgtcggtatcgggaaggctggtcgatgcgggacgccggtttagacgactcggcagccggagcaggcgtcttcctggcgtggaaggaacagcctctcgtgtgggcgagcgcgtggaggccatga

SEQ ID NO: 223 - protein, 594 aa, Zea mays
MDTLFRLVSLQASEQQQQQQSASYNSRSTTSSGSRSSSHQTNASYNYYYHSNSSGGGGGGQYYYGQQHPQQHQHQQYYLEPYQQEECGNTHHLYMDEDFSSSSSSRQHFHSHGAVVQPPTSSTATPTAPTPSLSTSSTAAGAAHALFEAADLSFPPDLNLDFSSPASSSGGGAASSAAVGGGGGGRWASQLLLECARAVAGRDSQRVQQLMWMLNELASPYGDVEQKLASYFLQGLFARLTASGPRTLRTLAAASDRNTSFDSTRRTALRFQELSPWSSFGHVAANGAILESFLEAAAASPEPQRLHILDLSNTFCTQWPTLLEALATRSADDTPHLSITTVVSSAPSAPTAAVQRVMREIGQRMEKFARLMGVPFSFRAVHHAGDLAGLDLDALDLRDGGATTALAINCVNSLRGVVPGGARRRDAFAASLRRLDPRVVTVVEEEADLVAFDPGAPEESGDTEAAFLKVFGEGLRFFSAYMDSLEESFPKTSNERLALERGAGRAIVDLVSCPASESMERRETAASWARRMRSSGFSPVAFSEDVADDVRSLLRRYREGWSMRDAGLDDSAAGAGVFLAWKEQPLVWASAWRP

SEQ ID NO: 224 - DNA, 1554 bp, Lactuca sativa
atggatactatgtccaccctccgacaccaacaactcctctctgattatcaacaacaacatcatcatcatcatcatcgtcaatctttcaactccaccgtaagttctagcagtcctagatcctccaccgatcatcaaacaaccaccggcgccggccattactaccaaccacaagaagaatgtttccctagtactttcttcatggaagaagatgatctctcttcttcttcctcattgcaacaacactactactcttctaaccagttacaaccccatttccaccaccagttttccgccactcctactcctacttccaccacaagcaccaccaccactcctcctccacctcccaagactcatggtttttcttctaattctgatcataccaactttaactactcgtcttcccaggatcatatcgctatggagttttcgaattcgttctccgccaacggctgggcgtcggatgtgttattggaggctgcgcgtgcggtggctgataagaacagcacgcgtctacagcagttgatgtggatgctcaacgagctcagttctccctatggcgatgtagatgagaagctttcttgttactttcttcaagcgctttacagtcggatgacggattccggtgagttgaattaccggaatttatcgtcgatttcggagaaagttagcacctttgaatcaaccagagaattggtgctcaagtttcaagaagtcagcccatggacgacgttcggacacgttgcgtgtaacggagcgatcttagaggcgttagacggcgagactaaattgcacattgttgatgtcagcaacacatactgcacacagtggccgacgttgctggaagccatcgccacccgggcagatgaagcaccacatctccgcctcacgacggtgatctcctccagatcagccggcagcgacggaatagagaggatcatgcgagaaatagggagtcggatggaaaaattcgccaggttaatgggtgtcccgtttaaattcaatgtgatacaccatatcggcgatttatccgatctgaattttagtcagttagctattcaatctgatgaagctcttgctataaacttaaatggcacgttacgttctgttagtaatcaccgtagggattatttgatctcgatgtttcggagtatgaaccctaaaataatgacgatcgtggaagaagaagctgatttggaagtggggattgatgggtttgaattcttgagaggatttcaagagtgtttgaaatggtttagggtttacttcgaagctctcaacgaaagctttcctcaaacgagtaccgagagattgatgttggagagggaggcggggcgggctgtgatggacttggtggcatgctcgccggcgaattccgtggagaggcgggagacggctaaccggtggtccagtagacttcgtgcaaatggttttggtggggtttcatatagcgaagaagggtgcgacgatgtccgggcactgctgaggaggtataaggaagggtggtcaatggctccgtcggaaacggcggccggaattttttttgatgcgtaa

SEQ ID NO: 225 - protein, 517 aa, Lactuca sativa
MDTMSTLRHQQLLSDYQQQHHHHHHRQSFNSTVSSSSPRSSTDHQTTTGAGHYYQPQEECFPSTFFMEEDDLSSSSSLQQHYYSSNQLQPHFHHQFSATPTPTSTTSTTTTPPPPPKTHGFSSNSDHTNFNYSSSQDHIAMEFSNSFSANGWASDVLLEAARAVADKNSTRLQQLMWMLNELSSPYGDVDEKLSCYFLQALYSRMTDSGELNYRNLSSISEKVSTFESTRELVLKFQEVSPWTTFGHVACNGAILEALDGETKLHIVDVSNTYCTQWPTLLEAIATRADEAPHLRLTTVISSRSAGSDGIERIMREIGSRMEKFARLMGVPFKFNVIHHIGDLSDLNFSQLAIQSDEALAINLNGTLRSVSNHRRDYLISMFRSMNPKIMTIVEEEADLEVGIDGFEFLRGFQECLKWFRVYFEALNESFPQTSTERLMLEREAGRAVMDLVACSPANSVERRETANRWSSRLRANGFGGVSYSEEGCDDVRALLRRYKEGWSMAPSETAAGIFFDA

SEQ ID NO: 226 - DNA, 1515 bp, Medicago truncatula
atggatacgctgtttaggcttgtcaattttcaacaacaacaacaacaatatcaacctgatccttccctcaactccaccaccaccttaacaacttctagcagctctagatcctcaagacaaacaacatatcattattacaaccaacaagaagaagacgaagaatgcttcaacaacttttattacatggatcataataacaacaatgatgaagatttatcctcatcttcttctaaacaacactattatacttatccttatgcttccactactactatcactactccaaacactacttataatactatcaacacccccaccacaactgataattactctttctcaccctcccatgattacttcaactttgaattctccggtcactcttggtcacaaaacatcctccttgaaactgcacgtgcattttccgacaataacacaaaccgaatccaacaactcatgtggatgctaaacgagcttagtaccccatatggtgacacagatcaaaaactttcatcttattttcttcaagctttgtttagtcgcatgaacgacgcgggagatagaacctacaaaaccttaacaaccgcgtcggaaaaaacatgttcctttgattcaacgaggaagatgttgttgaagttccaagaagttagtccatggacaacgtttggacacgtggcagctaacggtgctatcttagaagcattggaaggtaaccctaaacttcacataattgatattagcaacacttattgcactcaatggccaacactcctcgaagcgttggccacccgctctgatgatacgcctcaccttcgtttaaccactgtagtcactgcaatcagcggtggctcggtgcaaaaagtcatgaaggaaattggttcaaggatggaaaaatttgctaggcttatgggagtgccgtttaaattcaaaatcattttcagtgatttaagagagttgaatttgtgtgatttagatattaaagaagatgaagctttggctataaactgtgtaaactctttacattcgatatccggagccggaaaccaccgtgatttgtttatatctttgcttcgtgggttagaacctagggttttaactattgttgaagaagaagctgatttagaagtttgttttggttcggatttcgtggaaggttttaaagagtgtttaagatggtttagggtttattttgaagcacttgatgaaagtttttcaagaacaagtagtgagaggttgatgctagaaagagaagctgggagaggtattgttgatttggttgcttgtgatccttatgagtcagtggagagacgtgaaacggcggcgcggtggaggaggaggttgcatggtggcgggtttaatacggtgtcgtttagtgatgaagtttgtgatgatgttagggctttattgagaaggtataaagaagggtggtcgatgacatcctccgatggtgataccggaatattcttgtcgtggaaggataagccggtggtgtgggccagtgtatggaggccttga

SEQ ID NO: 227 - protein, 504 aa, Medicago truncatula
MDTLFRLVNFQQQQQQYQPDPSLNSTTTLTTSSSSRSSRQTTYHYYNQQEEDEECFNNFYYMDHNNNNDEDLSSSSSKQHYYTYPYASTTTITTPNTTYNTINTPTTTDNYSFSPSHDYFNFEFSGHSWSQNILLETARAFSDNNTNRIQQLMWMLNELSTPYGDTDQKLSSYFLQALFSRMNDAGDRTYKTLTTASEKTCSFDSTRKMLLKFQEVSPWTTFGHVAANGAILEALEGNPKLHIIDISNTYCTQWPTLLEALATRSDDTPHLRLTTVVTAISGGSVQKVMKEIGSRMEKFARLMGVPFKFKIIFSDLRELNLCDLDIKEDEALAINCVNSLHSISGAGNHRDLFISLLRGLEPRVLTIVEEEADLEVCFGSDFVEGFKECLRWFRVYFEALDESFSRTSSERLMLEREAGRGIVDLVACDPYESVERRETAARWRRRLHGGGFNTVSFSDEVCDDVRALLRRYKEGWSMTSSDGDTGIFLSWKDKPVVWASVWRP

SEQ ID NO: 228 - DNA, 1539 bp, Solanum tuberosum
atggatactttgtttagattagttacccttcaacaacaacaacaacaacaacaatctgatcaatattcttttaactccagcagaacttcaagcagctctagatcttctaacaaacaaaacacatataattatcatccacatcataataatcaagacgaagaatgcttcaactttttcatggatgaagatgatttctcttcttcttcttctaaacacaacaacaactatcctcctcctcattacaatcaatatcatcaacaaatttccaacactcccacaccgacaactacaagcagtaccccgacacaacaatctcaatctcatcactatgatcatcaattctccccagcacgtgatttaaatctcgaattcgcttcctcattttccggaaaatgggcgacggacattcttctagaaacttctcgtgccattgccgataagaacagtacacgtgtccaacaactcatgtggatgttgaatgagttgagttctccatatggagataccgaacaaaaattggcttcttattttcttcaagcattatttagccgtatgacggattctggcgaacgatgttatcgtacgttgttatccgcttcggataaaacatgttcgttcgagtcaacgaggaaattagttttgaaatttcaggaagttagcccttggacgacttttggtcacgttgcatccaatggtgcaattatggaagccttagaaggtgagtcaaagttgcatataattgatattagcaacacttattgtactcaatggcctactttactagaagcgctagcaacccgcaccgatgaaacaccgcatctccgcctcaccacggtggttgccgctagcggaggtgcagcgtccgtgcaaaaagtgatgaaggagattggtaatagaatggaaaaattcgctaggcttatgggcgtaccgtttaaattcaacgtcattcaccatgcgggaaatttatctgagttggatattggtgccttagatattaaaggagatgaagcgctagcaattaattgtattggtgcgttacattccgttacgccagctggcaatcgaagggattatttgatatcattatttaggaggttacaacctaggattgttacaattgttgaagaagaagctgatcttgatgttggtgttgatggtttcgattttgttaaaggttttcaagaatgtttgaaatggcttagggtttattttgaatcattagacgagagtttttcgaaaacaagtaacgaacgtttgatgctagagcgacaagcaggacgttcgattgttgatttactagcatgcccaccatcggagtcaatggagaggcgggaaacgggggcaaaatggtcacatcgtatgcatgcaggagggttcagtcagcttttatatagtgatgaagtttgtgatgatgttagagctttgttgagaaggtataaagatgggtggtcgatgggacagtgtgggggagattccgccggaatattcttgtcgtggaaggaacagccggtggtgtgggccagtgcatggaagccttaa

SEQ ID NO: 229 - protein, 512 aa, Solanum tuberosum
MDTLFRLVTLQQQQQQQQSDQYSFNSSRTSSSSRSSNKQNTYNYHPHHNNQDEECFNFFMDEDDFSSSSSKHNNNYPPPHYNQYHQQISNTPTPTTTSSTPTQQSQSHHYDHQFSPARDLNLEFASSFSGKWATDILLETSRAIADKNSTRVQQLMWMLNELSSPYGDTEQKLASYFLQALFSRMTDSGERCYRTLLSASDKTCSFESTRKLVLKFQEVSPWTTFGHVASNGAIMEALEGESKLHIIDISNTYCTQWPTLLEALATRTDETPHLRLTTVVAASGGAASVQKVMKEIGNRMEKFARLMGVPFKFNVIHHAGNLSELDIGALDIKGDEALAINCIGALHSVTPAGNRRDYLISLFRRLQPRIVTIVEEEADLDVGVDGFDFVKGFQECLKWLRVYFESLDESFSKTSNERLMLERQAGRSIVDLLACPPSESMERRETGAKWSHRMHAGGFSQLLYSDEVCDDVRALLRRYKDGWSMGQCGGDSAGIFLSWKEQPVVWASAWKP

SEQ ID NO: 230 - DNA, 1485 bp, Eucalyptus grandis
atggataccttgtttagactagtgagccttcaatcctccgatcagtccttcaactcaagcaggacctcaagcagctccagatcctcccgacaaaaccatcactaccatcaccagccagaagcggacgaagaatgcctcaacatcttcatggatgaagaagacttctcctcgtcttcttccaagcactacagttatccttatcaccccgccaccaccagcaccacccctaccaccactagtagtactcacactccccacacttatgaccctgccgatgtatccgtctcgcccgcccgcgacctcaacttcgacttctctagcaagtgggcctctgacatcctcctcgagacggcccgtgccatcgtcgacaagaacagcacccgtgtccagcaccttatgtggatgctcaatgagctctgctccccttatggcgacatcgagcagaagctggcctcctacttcctccaggccctgtttagtcgcatgacggactcgggcgagcggagctacagtgcctggttggccgcgtcggacaagacctgctccttcgagtccacccggaagatggtgctcaagttccaggaggtgagcccctggaccaccttcgggcacgtcgcgtgcaacggcgcaatcatggaggcccttgagggggagagcaagttgcacatagttgacatcagcaacacgtactgcacccagtggccaaccctgctcgaggctctggccacccggacggatgagacgccacacctgcggctcaccaccgtggtggtgagcaaggcgaacggcggggcagagactagtggcgtcgtcgccgtgcagaaggtcatgaaagaaattgggagccggatggagaaatttgcgaggctcatgggtgtgcccttcaagttcagcgtcctgtaccacagtggcgacctgtcagagttgaatttggacgagttggatatcaaggaggacgaggcgctggccatcaactgcgttggcgcgctgcactcgacaacgacagtcagcaaccgccgggactttgtggtctcatctttccgaaggttgcaaccgaggataatcacggttgttgaggaggaagccgacctcgacgtgggcgtggatgggatcgaatttgtcaggggtttccaagaaagcctgagatattttagggtttacttcgagtcgttggacgagagcttccctagaacgagcaacgagcgcttgatgctcgagcgaggggctgggcgagcggtcatggacctggtggcatgcccaccacaccactcggtggagaggcgggagccagcaagccggtggtcgaggcgcctgcgaggaggcgggtttaatccttgtttgttcagcgacgaggtatgcgacgacgtgcgtgccttgttgaggaggtacaaggaagggtggtcgatgacgccgtgctctgacgccggaatattcttgacgtggaaggaccagccggtggtttgggctagtgcatggagggcttga

SEQ ID NO: 231 - protein, 494 aa, Eucalyptus grandis
MDTLFRLVSLQSSDQSFNSSRTSSSSRSSRQNHHYHHQPEADEECLNIFMDEEDFSSSSSKHYSYPYHPATTSTTPTTTSSTHTPHTYDPADVSVSPARDLNFDFSSKWASDILLETARAIVDKNSTRVQHLMWMLNELCSPYGDIEQKLASYFLQALFSRMTDSGERSYSAWLAASDKTCSFESTRKMVLKFQEVSPWTTFGHVACNGAIMEALEGESKLHIVDISNTYCTQWPTLLEALATRTDETPHLRLTTVVVSKANGGAETSGVVAVQKVMKEIGSRMEKFARLMGVPFKFSVLYHSGDLSELNLDELDIKEDEALAINCVGALHSTTTVSNRRDFVVSSFRRLQPRIITVVEEEADLDVGVDGIEFVRGFQESLRYFRVYFESLDESFPRTSNERLMLERGAGRAVMDLVACPPHHSVERREPASRWSRRLRGGGFNPCLFSDEVCDDVRALLRRYKEGWSMTPCSDAGIFLTWKDQPVVWASAWRA

SEQ ID NO: 232 - DNA, 1485 bp, Vitis vinifera
  misc_feature (270)..(270): n is a, c, g, or t
atggataccttgtttagactagtcagtcttcaatccgatcaatcctacaactccagtagaacttctagcagctctagatcttctagacaaaaccatcaccaccaccaccaagaagacgaagaatgcttcaactttttcatggatgaagaagacttctcttcttcttcttccaagcactactatccttatcagcaacaaacccatccttcttcaccaccacccccaccaccaccaacaccagcactcctactcatcatgcctttgagcccnaccgaattctctttctcccctgcccgtgatctccacctagaattcaactcttctgcttccggcaagtgggcttccgaaatcctcctggagacagcacgagccatcgctgataagaacagcgctcgcgttcaacaactcatgtggatgctcaacgagcttagctctccttatggcgacaccgatcagaagctcgctgcttacttccttcaagccttgtttagccgcatgaccgactcgggtgagaggtgttaccggactttaatatccgcatcggagaagacttgctcattcgaatccaccagaaaaatggtattgaaatttcaagaggtgagcccttggaccacgtttggacatgtagcttgtaatggtgcaatcatggaagctcttgaaggcgagagcaagctccatataattgatataagcaacacctactgcactcagtggcccaccttgctcgaagccctagccacccgcactgacgagacccctcacctccgtctcaccaccgtcgtcacaagcaaagccggcaccggagggatggcaccagtgcaaaaactgatgaaagagattggaaacagaatggaaaagttcgctaggctcatgggtgtgcccttcaaattcaacgtactgcaccactccggcgacctatcccatctgaatttagcagaattggacatcaaagacgacgaggcactcgccgtaaactgcgtcggcgcgttgcactcagtcaccgcagttggtaaccgccgagacatcgtcgtatcatctttccggagattgcatccgaggatcatcaccgtcgtggaagaagaagctgatctcgatgtgggcgtggatgggttcgacttcgtcaaaggttttcaggaatgcttaagatggtttagggtttacttggagtcattagacgagagcttcccacgcactagcaacgagcgcctcatgctcgaacgcgccgccggacgmgcaatcgtcgacctggtggcttgcccgccgtcggagtcgatcgaacggcgcgagacggccacgcgctggtckcagcggctccatgcaagcgggttctctccggtgtcgtttagcgatgaagtatgcgatgacgtacgtgctctcctgaggagatacaaggagggttggtcaatgacacagtcctccgacgccggaatattcctctcatggaaagaccagccggtggtgtggaccagtgcatggaaaccttga

SEQ ID NO: 233 - protein, 494 aa, Vitis vinifera
MDTLFRLVSLQSDQSYNSSRTSSSSRSSRQNHHHHHQEDEECFNFFMDEEDFSSSSSKHYYPYQQQTHPSSPPPPPPPTPALLLIMPLSPTEFSFSPARDLHLEFNSSASGKWASEILLETARAIADKNSARVQQLMWMLNELSSPYGDTDQKLAAYFLQALFSRMTDSGERCYRTLISASEKTCSFESTRKMVLKFQEVSPWTTFGHVACNGAIMEALEGESKLHIIDISNTYCTQWPTLLEALATRTDETPHLRLTTVVTSKAGTGGMAPVQKLMKEIGNRMEKFARLMGVPFKFNVLHHSGDLSHLNLAELDIKDDEALAVNCVGALHSVTAVGNRRDIVVSSFRRLHPRIITVVEEEADLDVGVDGFDFVKGFQECLRWFRVYLESLDESFPRTSNERLMLERAAGRAIVDLVACPPSESIERRETATRWSQRLHASGFSPVSFSDEVCDDVRALLRRYKEGWSMTQSSDAGIFLSWKDQPVVWTSAWKP

SEQ ID NO: 234 - DNA, 1533 bp, Populus trichocarpa
atggataccttgtttaggctagttagtctccaacaacaatctgaacaatctttcaactctactagcagaacctctagtagctctagatcatcaagacaaaacaacaaccaccaccatcatcactatcaacaagaagacgaagaatgcttcaactttttcatggatgaggaagacttctcttcatcttcttctaagcactactatcctccttatcaccacaaccaacaacaacaacatcaacaccaaaccaccaccaccactcctaccactactaccaccaacactagcaccccttctactcaccatgtccttgattccgctgacttctctttctccccttctcatgacctaaactttgaattttccggcaagtgggtcaccgatatcctccttgaatctgcacatgccatcgcggataaaaacagcgctcgtctccagcaattgatgtggatgcttaatgagcttggttcaccttatggtgacacagagcaaaaacttgcttcttattttctccaagctttgtttagccgcatgaacgactccggcgagagatgctaccgtactttagcttcagcatcagagaaaacttgctcttttgattccacaaggaaaatggtattaaagtttcaagaggtgagtccttggactacttttggtcacgtatcttgtaatggcgcaattatggaagcatttgaaggtgaaagcaaattgcatattattgatattagtaacacatattgtacccaatggcctactttgctcgaagccctagcaactcgcactgatgagacaccacacttgaagttaaccaccgtagtggctagcaaaagtagtggtaataatattggtttaactagtacaggaggtttagcttcagttcataaggtaatgaaagaaattggcaacagaatggaaaaatttgccaggcttatgggagtcccatttaagtttaatgttatccaccatgctggtgatttatgtgacctaaacttagctgaattggatgttaaagatgatgaggctcttgctatcaactgtgttggtgctttacactcaatcactccagcttctcgtcgccgagattatgttatatctagttttagaacattgcaaccaagaatcattactgttgttgaagaagaagctgatcttgatggtctggattttgtcaagggttttcaagaatgtttaagatggtttagggtttactttgaatcattggatgagagctttccaagaaccagtaacgaacagttgatgcttgaaagagcagcaggccgcgctatcgttgacttagtggcatgtcctccatctgattcgatcgaaaggcgggaaacagccacgcgctggtctggacgcctccattcatgtggttttagcccgataattttcagtgatgaggtttgtgatgatgtacgcgccttattgaggaggtataaggagggttggtcaatgacacagtgcggggatgccggaatattcttgtgctggaaggaacagccggtggtgtgggctagtgcatggaggccctga

SEQ ID NO: 235 - protein, 510 aa, Populus trichocarpa
MDTLFRLVSLQQQSEQSFNSTSRTSSSSRSSRQNNNHHHHHYQQEDEECFNFFMDEEDFSSSSSKHYYPPYHHNQQQQHQHQTTTTTPTTTTTNTSTPSTHHVLDSADFSFSPSHDLNFEFSGKWVTDILLESAHAIADKNSARLQQLMWMLNELGSPYGDTEQKLASYFLQALFSRMNDSGERCYRTLASASEKTCSFDSTRKMVLKFQEVSPWTTFGHVSCNGAIMEAFEGESKLHIIDISNTYCTQWPTLLEALATRTDETPHLKLTTVVASKSSGNNIGLTSTGGLASVHKVMKEIGNRMEKFARLMGVPFKFNVIHHAGDLCDLNLAELDVKDDEALAINCVGALHSITPASRRRDYVISSFRTLQPRIITVVEEEADLDGLDFVKGFQECLRWFRVYFESLDESFPRTSNEQLMLERAAGRAIVDLVACPPSDSIERRETATRWSGRLHSCGFSPIIFSDEVCDDVRALLRRYKEGWSMTQCGDAGIFLCWKEQPVVWASAWRP

SEQ ID NO: 236 - DNA, 1539 bp, Ricinus communis
atggatacgttgtttaggctagttagtcttcaacaacagcaatctgatcaatctttcaataactctactagcagaacctctagcagctctagatcctcaagacaaaacaaccaccaccatcatcatcatcagtaccaacaagaagacgaagaatgcttcaactttttcatggatgaagaagacttctcttcgtcttcttctaaacactactatccttatcaccatcaacaacagcaacaacacaccaccgccaccactactactactactgtgaccactcctaacactaccactagtactcttgaatccactgaccacttctctttctctccttcccatgacctaaactttgacttctccagcaggtgggcaaccgatatcctcctcgaaactgctcgtgctattgctgataaaaacagtgctcgtgttcagcaactcatgtggatgcttaatgaacttggctcgccttatggggacatagacaaaaagcttgcatcatactttctacaagccttgttcagccggatgactgattccggtgagagatgttaccgtactttagcctctgcatcggataaaacttgctctttcgagtcaacaagaaagatggtattgaagtttcaagaggtgagtccttggactacttttggtcacgtatcttgtaatggtgcaataatggaagcatttgaaggtgaaagtaaattgcatattattgatattagtaacacatattgcactcagtggccaacgttgctagaagccctagcaactcgcaccgatgagacaccccacttgaggctaaccaccattgtggctagtaaaacaaatggtggtgggggcggcggcggtggcaattgtggtttagtttcagcccagaaagtaatgaaagaaattggaagcagaatggaaaaatttgctaggcttatgggagtaccatttaaattcaatgttatacaccatgctggtgacttgtgtgacctgaacttatctgaattggatattaaagaagatgaagctttagccatcaattgtatagggtcactgcattcagttacaacagttgctaatcgtagagattatataatatcaaactttagaagattacaaccaagaatcatcactattgttgaagaagaagctgatcttgatgtgggtattgatgggttagactttgtaagaggttttcaagaatgtttaagatggtttagggtttactttgagtcattagaagaaagtttttcaagaacaagcaatgaaagattgatgctagagagaagtgctggacgtgcaatagttgacttggttgcatgtcagccatcagagtcaattgaacggcgggaaaaggcgacacggtggtcctcacggttgcatgcatgtggatatagccctattctgtttagtgatgaggtatgcgatgatgtacgcgcccttttgaggaggtataaggaaggctggtcaatgacacagagcggccacgccggaatattcctatgctggaaggaacagccggtcgtgtgggctagtgcatggaaaccttga

SEQ ID NO: 237 - protein, 512 aa, Ricinus communis
MDTLFRLVSLQQQQSDQSFNNSTSRTSSSSRSSRQNNHHHHHHQYQQEDEECFNFFMDEEDFSSSSSKHYYPYHHQQQQQHTTATTTTTTVTTPNTTTSTLESTDHFSFSPSHDLNFDFSSRWATDILLETARAIADKNSARVQQLMWMLNELGSPYGDIDKKLASYFLQALFSRMTDSGERCYRTLASASDKTCSFESTRKMVLKFQEVSPWTTFGHVSCNGAIMEAFEGESKLHIIDISNTYCTQWPTLLEALATRTDETPHLRLTTIVASKTNGGGGGGGGNCGLVSAQKVMKEIGSRMEKFARLMGVPFKFNVIHHAGDLCDLNLSELDIKEDEALAINCIGSLHSVTTVANRRDYIISNFRRLQPRIITIVEEEADLDVGIDGLDFVRGFQECLRWFRVYFESLEESFSRTSNERLMLERSAGRAIVDLVACQPSESIERREKATRWSSRLHACGYSPILFSDEVCDDVRALLRRYKEGWSMTQSGHAGIFLCWKEQPVVWASAWKP

SEQ ID NO: 238 - DNA, 1512 bp, Glycine max
atggataccttgtttagactagtaagttttcatcaacagcaacaaccacaacaacaacctgatccatccctcaactccaccaccagcagaacctccagcagctccagatcctccagacaaaactactacccttattcccatcaagaagaagaagaatgcttcaacttttacatggatgaagaagacttatcctcgtcttcttccaaacactactaccacccttatcaaccccatcatcatcaacaacacaacgtatccaacatttctacaaacaccttcagcaccacccctaacactgattactcctactcctactccttctctcccacgcaacctgttcaagacttcaacttcgaattctcctcccccaactggtcccacaacctcctcctcgaatccgcacgcgccgtcgccgacaacaactccacgcgcctccaccacctcctctggatgctcaacgagctcagctccccctacggcgacaccgaacaaaaacttgctgcgtatttcctccgagccttgttcagccgcgtcaccgaagctggcgaccgaacctaccgaagcttagcttcggcgtctgagaaaacatgctcatttgaatccacaagaaaaacggtcctgaaattccaagaagttagcccttggactaccttcggacacgtggcatccaatggcgccatcttggaagccttggagggaaactccaaattgcatatacttgacatcagcaacacttattgcacccagtggccaatgcttctggaagcattggccactcggagcgaagaaactccacacctatgtttaacaacaattgttactggttctagaatcggtaacaacgtccagcgcgtgatgaaggaaatcggaacgcgaatggagaaattcgccagactcatgggcgttccttttaagttcaacgtcgttcatcactacggcgatctatccgagttcaatttctcagagcttgatatcaaagacgatgaggctttggctgtgaattgtgtgaactcgctgcattcggtttccgcgctaggaaacaaccgcgacgcgttgatatcggcgttgcaagcgttgcagccgcggattgtgacggtggtggaggaggaggctgatttggacgttggaatcgacggttacgagttcgtaaaaggctttgaagaaagtttgaggtggtttagggtttactttgaggctttggatgagagttttgtgaagacgagcaacgagaggctgatgctggagcgcgcggcggggagggcggtggtggacctggtggcgtgctcgccggcggattccgtggagcgccgcgagacggcggcgcggtgggcggcgaggcttcacaacggagggctaaacgcggcgccgtttagcgacgaagtttgcgacgacgtgagggcgctgttgaggaggtacaaggaagggtggtcgatggcggcgtgctccgacgccggaatattcctctcgtggaaggacacgccggtggtgtgggccagtgcatggaggccataa

SEQ ID NO: 239 - protein, 503 aa, Glycine max
MDTLFRLVSFHQQQQPQQQPDPSLNSTTSRTSSSSRSSRQNYYPYSHQEEEECFNFYMDEEDLSSSSSKHYYHPYQPHHHQQHNVSNISTNTFSTTPNTDYSYSYSFSPTQPVQDFNFEFSSPNWSHNLLLESARAVADNNSTRLHHLLWMLNELSSPYGDTEQKLAAYFLRALFSRVTEAGDRTYRSLASASEKTCSFESTRKTVLKFQEVSPWTTFGHVASNGAILEALEGNSKLHILDISNTYCTQWPMLLEALATRSEETPHLCLTTIVTGSRIGNNVQRVMKEIGTRMEKFARLMGVPFKFNVVHHYGDLSEFNFSELDIKDDEALAVNCVNSLHSVSALGNNRDALISALQALQPRIVTVVEEEADLDVGIDGYEFVKGFEESLRWFRVYFEALDESFVKTSNERLMLERAAGRAVVDLVACSPADSVERRETAARWAARLHNGGLNAAPFSDEVCDDVRALLRRYKEGWSMAACSDAGIFLSWKDTPVVWASAWRP

SEQ ID NO: 240 - DNA, 1476 bp, Medicago truncatula
atggatacattgtttagacttgtcagttttcaaccacaccaacaacaagaagatcaatctctcaactccaccaccagcagaacaacaacatcaagtagctctcgatcctcaaaacaaaactatcaccaatattacaatccacaagaagttgaagaagaatgcttcaactttttcatggatgaagaagacctttcctcatcttcttccaaacactactatccttataatcaacctcaaacctcaaatactattactacaaacacccccacaacatcactcacaccccctccaccaacagctgatttcaccttcgaattaaccggaaggtgggccaacaacatcctcctcgaaacagcacgagccatagcagaaaaaaacagcactcgtttacaacaactcatgtggatgcttaacgaactaagctccccttatggtgacatagaacaaaaactagctgcatattttctccaagccttattctctcgaatgaccgaagccggtacccgaaccttccgaaccctagcttcagcatcagaaaaaacttgctctttcgaatcaacaagaaaaacggttctaaaattccaagaagttagtccgtggacaaccttcggccatgtcgcatgcaatggcgccattttagaagccttcgaaggtgattccaagctgcacataattgatattagtaacacttattgcactcagtggccaactctttttgaagcgttggccactcgtgctgacgatactcctcacctccgtctaactaccatcgtcactgctggtggttctgttcaaaaagttatgaaggaaattggtgctagaatggaaaaattcgctagactcatgggagttccatttaaattcaacgttattcatcactccggcgatctttctgatttgaattttttggatttagatattaaagaagatgaagctttagctgttaattgtgttaatgctttgcattcagtaacagttggcaatggtaatggtaacggtaataaccgtcgtgactcgttgatagcttcgttgatcgcgttgcggcctaggatagtaacaatggttgaagaggaggctgatttaaattttggtaatgaaggatatgaatttgtgaatggttttgaagagtgtttaaggtggtttagggtttactttgaagcattagaagagagttttccgaagacgagtaacgagcgtttgatgcttgaaagggaagcagggagagggatagttgatttggtggcatgtgctccggcggagtcgattgaacggagagaaactgcggtgaggtggtcacggcgtttgcatggtcgagggtttaatacggtggcgtttagtgaggaagtttgtgatgatgttagggctttgttgaggaggtataaggaagggtggtcgatgatacggtgtaatgatgccggaatattcttgacgtggaaggaacaaccggtggtgtgggccagtgcatggaggccttga

SEQ ID NO: 241 - protein, 491 aa, Medicago truncatula
MDTLFRLVSFQPHQQQEDQSLNSTTSRTTTSSSSRSSKQNYHQYYNPQEVEEECFNFFMDEEDLSSSSSKHYYPYNQPQTSNTITTNTPTTSLTPPPPTADFTFELTGRWANNILLETARAIAEKNSTRLQQLMWMLNELSSPYGDIEQKLAAYFLQALFSRMTEAGTRTFRTLASASEKTCSFESTRKTVLKFQEVSPWTTFGHVACNGAILEAFEGDSKLHIIDISNTYCTQWPTLFEALATRADDTPHLRLTTIVTAGGSVQKVMKEIGARMEKFARLMGVPFKFNVIHHSGDLSDLNFLDLDIKEDEALAVNCVNALHSVTVGNGNGNGNNRRDSLIASLIALRPRIVTMVEEEADLNFGNEGYEFVNGFEECLRWFRVYFEALEESFPKTSNERLMLEREAGRGIVDLVACAPAESIERRETAVRWSRRLHGRGFNTVAFSEEVCDDVRALLRRYKEGWSMIRCNDAGIFLTWKEQPVVWASAWRP

SEQ ID NO: 242 - DNA, 2194 bp, Oryza sativa; identical to SEQ ID NO: 45

SEQ ID NO: 243 - DNA, 60 bp, Artificial sequence
  primer: prm07341
ggggacaagtttgtacaaaaaagcaggcttaaacaatggatactctctttagactagtca

SEQ ID NO: 244 - DNA, 50 bp, Artificial sequence
  primer: prm07342
ggggaccactttgtacaagaaagctgggtaaataaaaacaaccctttacg

SEQ ID NO: 245 - protein, 54 aa, Artificial sequence
  TCP domain of the TCP1 polypeptides
  MISC_FEATURE (8)..(8): Xaa can be Asn or Asp
  MISC_FEATURE (14)..(14): Xaa can be Ile or Val
  MISC_FEATURE (19)..(19): Xaa can be Ile or Val
  MISC_FEATURE (33)..(33): Xaa can be His or Leu
KDRHSKVXGRGRRXRMPIXCAARVFQLTRELGXKSDGQTIEWLLRQAEPSIIAA

SEQ ID NO: 246 - protein, 14 aa, Artificial sequence
  Domain A of the TCP1 polypeptides
  MISC_FEATURE (3)..(3): Xaa can be Ser or Thr
  MISC_FEATURE (9)..(9): Xaa can be Ala, Ser or Val
  MISC_FEATURE (11)..(11): Xaa can be Ser or Val
  MISC_FEATURE (12)..(12): Xaa can be Cys, Ser or Thr
  MISC_FEATURE (13)..(13): Xaa can be Ala, Leu, Pro, Ser, Val, or not present
TGXGTTPAXFXXXS

SEQ ID NO: 247 - protein, 9 aa, Artificial sequence
  Domain B of the TCP1 polypeptides
  MISC_FEATURE (1)..(1): Xaa can be His, Ser or Pro
  MISC_FEATURE (2)..(2): Xaa can be Phe or Thr
  MISC_FEATURE (3)..(3): Xaa can be Ile or Leu
  MISC_FEATURE (8)..(8): Xaa can be Gln, Leu, Met, Pro or Val
  misc_feature (9)..(9): Xaa can be any naturally occurring amino acid
XXXLGKRXX

SEQ ID NO: 248 - protein, 12 aa, Artificial sequence
  Domain C of the TCP1 polypeptides
  MISC_FEATURE (1)..(1): Xaa can be Gly or not present
  MISC_FEATURE (2)..(2): Xaa can be His or not present
  MISC_FEATURE (7)..(7): Xaa can be Ala or Ser
  MISC_FEATURE (8)..(8): Xaa can be Ala or Ser
  MISC_FEATURE (11)..(11): Xaa can be Gly or Ser
  MISC_FEATURE (12)..(12): Xaa can be Ala, Gly or Ser
XXLNLLXXLSXX

The invention claimed is:

1. A method for enhancing yield-related traits in a plant relative to a control plant, said method comprises modulating expression of a nucleic acid encoding a TCP 1 polypeptide in a plant, and selecting a plant having enhanced yield-related traits on the basis of said plant showing enhanced yield-related traits relative to a control plant, wherein said TCP 1 polypeptide comprises an amino acid sequence having at least 95% sequence identity to the amino acid sequence of SEQ ID NO: 2.

2. The method of claim 1, wherein said TCP1 polypeptide comprises the amino acid sequence of SEQ ID NO: 2 or is encoded by a nucleic acid comprising the nucleotide sequence of SEQ ID NO: 1.

3. The method of claim 1, wherein said modulated expression is increased expression of said nucleic acid encoding a TCP1 polypeptide.

4. The method of claim 3, wherein said increased expression is effected by any one or more of T-DNA activation tagging, TILLING, or homologous recombination.

5. The method of claim 3, wherein said increased expression is effected by introducing and expressing in a plant the nucleic acid encoding a TCP1 polypeptide.

6. The method of claim 1, wherein said enhanced yield-related traits comprise increased seed weight relative to a control plant.

7. The method of claim 5, wherein said nucleic acid is operably linked to a constitutive promoter, to a HMGP (High Mobility Group Protein) promoter, or to a GOS2 promoter.

8. The method of claim 5, wherein said nucleic acid encoding a TCP1 polypeptide is of plant origin.

9. A plant or part thereof including seeds obtained by the method of claim 1, or a progeny of said plant, wherein said plant or part thereof, or said progeny, comprises a nucleic acid transgene encoding the TCP 1 polypeptide.

10. A construct comprising:
(i) a nucleic acid sequence encoding a TCP 1 polypeptide;
(ii) one or more control sequences capable of driving expression of the nucleic acid sequence of (i); and optionally
(iii) a transcription termination sequence,
wherein said TCP 1 polypeptide comprises an amino acid sequence having at least 95% sequence identity to the amino acid sequence of SEQ ID NO: 2.

11. The construct of claim 10, wherein said TCP1 polypeptide comprises the amino acid sequence of SEQ ID NO: 2 or is encoded by a nucleic acid comprising the nucleotide sequence of SEQ ID NO: 1.

12. The construct of claim 10, wherein said one or more control sequences is at least a constitutive promoter, an HMGP promoter, or a GOS2 promoter.

13. A method for obtaining a plant having increased yield or increased seed yield relative to a control plant, comprising growing a plant which comprises the construct of claim 10.

14. A plant, plant part, or plant cell transformed with the construct of claim 10, or a progeny of said plant, wherein said progeny comprises said construct.

15. A method for the production of a transgenic plant having increased seed yield relative to a control plant, comprising:
introducing and expressing in a plant or plant cell a nucleic acid encoding a TCP 1 polypeptide;
(ii) cultivating the plant or plant cell under conditions promoting plant growth and development; and
(iii) selecting a plant having increased seed yield on the basis of said plant showing increased seed yield relative to a control plant,
wherein said TCP1 polypeptide comprises an amino acid sequence having at least 95% sequence identity to the amino acid sequence of SEQ ID NO: 2.

16. The method of claim 15, wherein said TCP1 polypeptide comprises the amino acid sequence of SEQ ID NO: 2 or is encoded by a nucleic acid comprising the nucleotide sequence of SEQ ID NO: 1.

17. A transgenic plant having increased yield or increased seed yield relative to a control plant resulting from increased expression of a nucleic acid encoding a TCP1 polypeptide, or a transgenic plant cell or progeny derived from said transgenic plant, wherein said transgenic plant cell or progeny comprises the nucleic acid encoding the TCP1 polypeptide, and wherein said TCP 1 polypeptide comprises an amino acid sequence having at least 95% sequence identity to the amino acid sequence of SEQ ID NO: 2.

18. The transgenic plant of claim 17, wherein said TCP1 polypeptide comprises the amino acid sequence of SEQ ID NO: 2 or is encoded by a nucleic acid comprising the nucleotide sequence of SEQ ID NO: 1.

19. The transgenic plant of claim 17, wherein said plant is a crop plant or a monocot or a cereal, or a transgenic plant cell derived from said transgenic plant.

20. The transgenic plant of claim 17, wherein said increased seed yield is one or more of the following: (i) increased seed weight; (ii) increased harvest index; (iii)

increased Thousand Kernel Weight, (iv) increased number of flowers per panicle, (v) increased fill rate, or (vi) increased number of filled seeds.

21. The plant of claim 9, wherein said plant is a crop plant or a monocot or a cereal, or a transgenic plant cell derived from said plant.

22. Harvestable parts of the plant of claim 21, wherein said harvestable parts comprise seeds having the nucleic acid transgene encoding the TCP 1 polypeptide.

23. Products derived from the plant of claim 21 and/or from harvestable parts of said plant, wherein the products comprise said nucleic acid transgene encoding a TCP1 polypeptide.

24. The method of claim 8, wherein the plant is from the Medicago family.

* * * * *